(12) United States Patent
Bahekar et al.

(10) Patent No.: US 8,383,581 B2
(45) Date of Patent: Feb. 26, 2013

(54) SHORT-CHAIN PEPTIDES AS PARATHYROID HORMONE (PTH) RECEPTOR AGONIST

(75) Inventors: Rajesh Bahekar, Ahmedabad (IN); Mukul R. Jain, Ahmedabad (IN); Pankaj R. Patel, Ahmedabad (IN)

(73) Assignee: Cadila Healthcare Limited, Ahmedabad (IN)

( * ) Notice: Subject to any disclaimer, the term of this patent is extended or adjusted under 35 U.S.C. 154(b) by 0 days.

(21) Appl. No.: 13/259,706

(22) PCT Filed: Apr. 26, 2010

(86) PCT No.: PCT/IN2010/000264
§ 371 (c)(1),
(2), (4) Date: Jan. 10, 2012

(87) PCT Pub. No.: WO2010/128521
PCT Pub. Date: Nov. 11, 2010

(65) Prior Publication Data
US 2012/0108496 A1 May 3, 2012

(30) Foreign Application Priority Data

Apr. 24, 2009 (IN) .......................... 1095/MUM/2009
Jan. 28, 2010 (IN) ............................ 225/MUM/2010

(51) Int. Cl.
*A61K 38/29* (2006.01)

(52) U.S. Cl. ........................................ 514/2.3; 514/11.8
(58) Field of Classification Search ................... 514/2.3
See application file for complete search history.

(56) References Cited

PUBLICATIONS

Shimizu et al., Journal of Bone and Mineral Research (2004) vol. 19, No. 12, pp. 2078-2086.*

* cited by examiner

*Primary Examiner* — Karlheinz R Skowronek
*Assistant Examiner* — Catherine Mader
(74) *Attorney, Agent, or Firm* — Ladas & Parry LLP

(57) ABSTRACT

The present invention provides novel short-chain peptides, which primarily act as parathyroid hormone (PTH/PTH-1) receptor agonist. These short-chain peptides exhibit increased stability to proteolytic cleavage. Most of short-chain peptides were found to be stable in rat plasma up to 24 hours (in vitro), showed increased stability against GIT enzymes such as pepsin and acidic stomach pH and also against liver microsomes (in vitro). Due to increased metabolic stability, other than parenteral route of administration, some of the short-chain peptides can also be delivered by oral routes of administration, for the treatment/prevention of hypoparathyroidism and diseases characterized by bone mass reduction, such as osteoporosis, postmenopausal osteoporosis and for stimulating bone repair.

$A\text{-}Z_1\text{-}Z_2\text{-}Z_3\text{-}Z_4\text{-}Z_5\text{-}Z_6\text{-}Z_7\text{-}Z_8\text{-}Z_9\text{-}Z_{10}\text{-}Z_{11}\text{-}Z_{12}\text{-}Z_{13}\text{-}Z_{14}\text{-}Z_{15}\text{-}B$

20 Claims, 8 Drawing Sheets

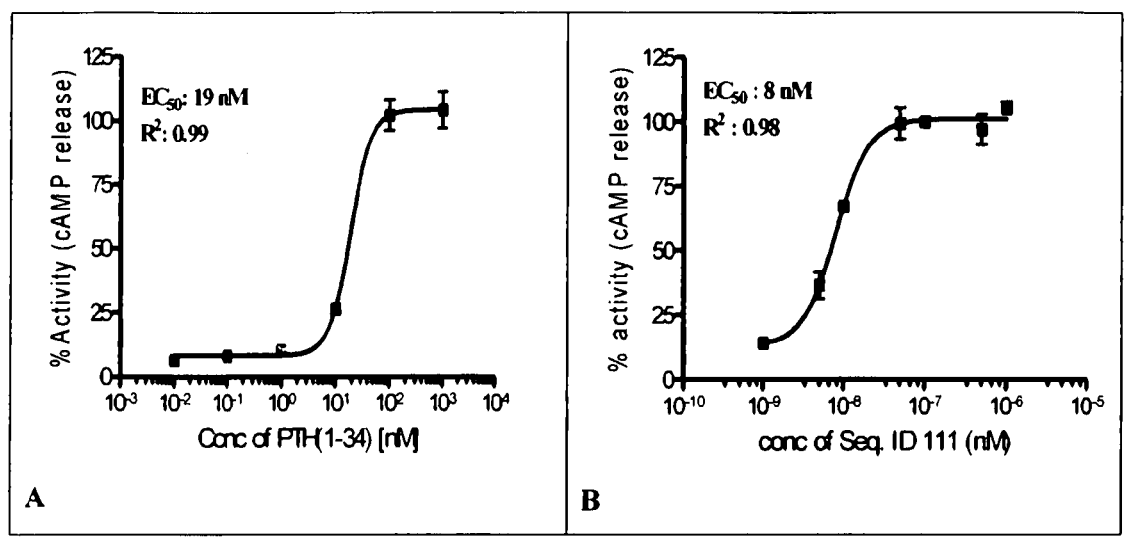
Figure 1: *In vitro* DRC and EC$_{50}$ determination of PTH(1-34) (Figure A) and Seq. ID No. 111 (Figure B), in Rat PTH-1 R assay (agonistic activity, measured by amount of cAMP released).

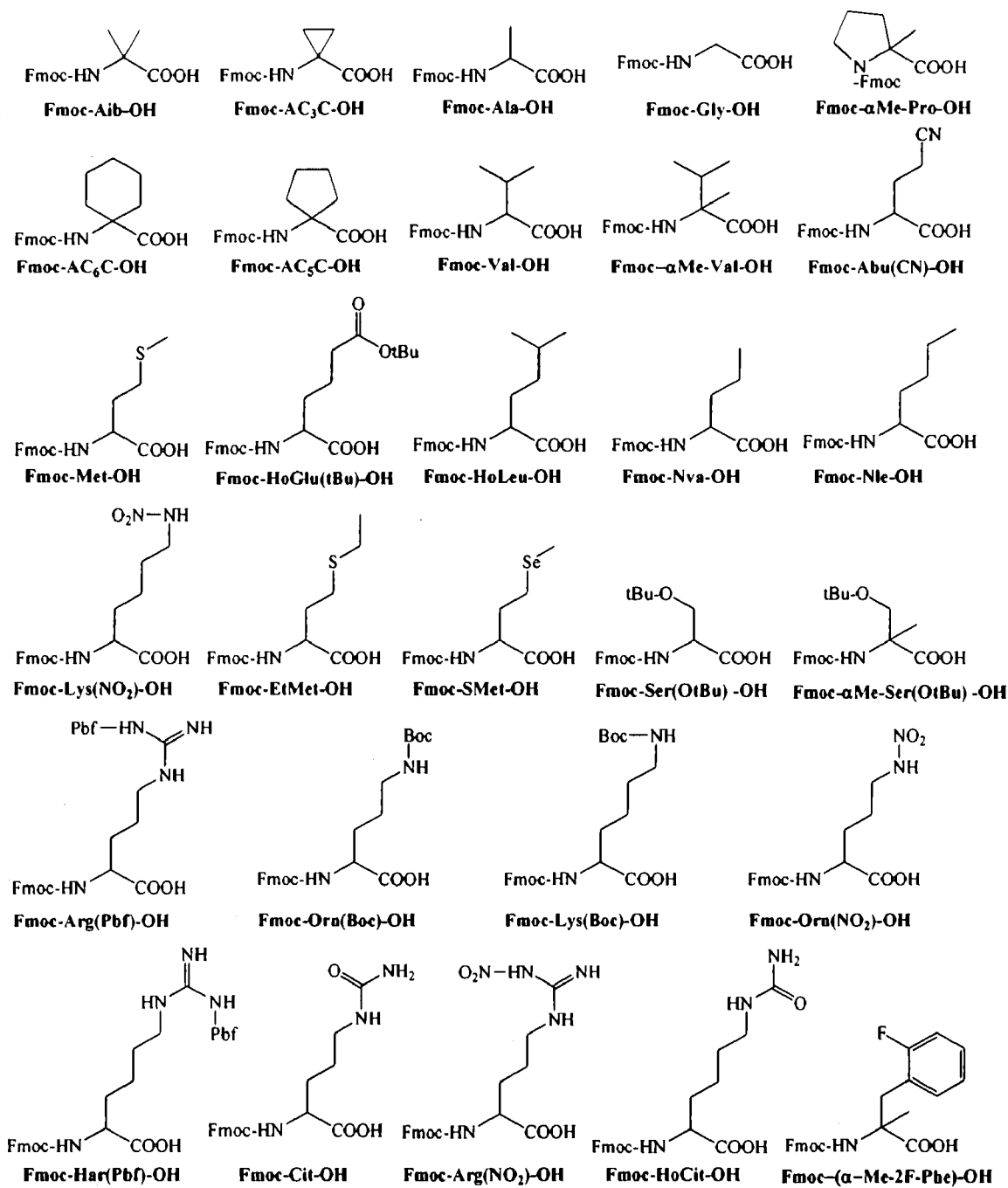
Figure 2: Examples of orthogonally protected amino acids used in Fmoc based-solid phase peptide synthesis (SPPS) of short-chain peptides.

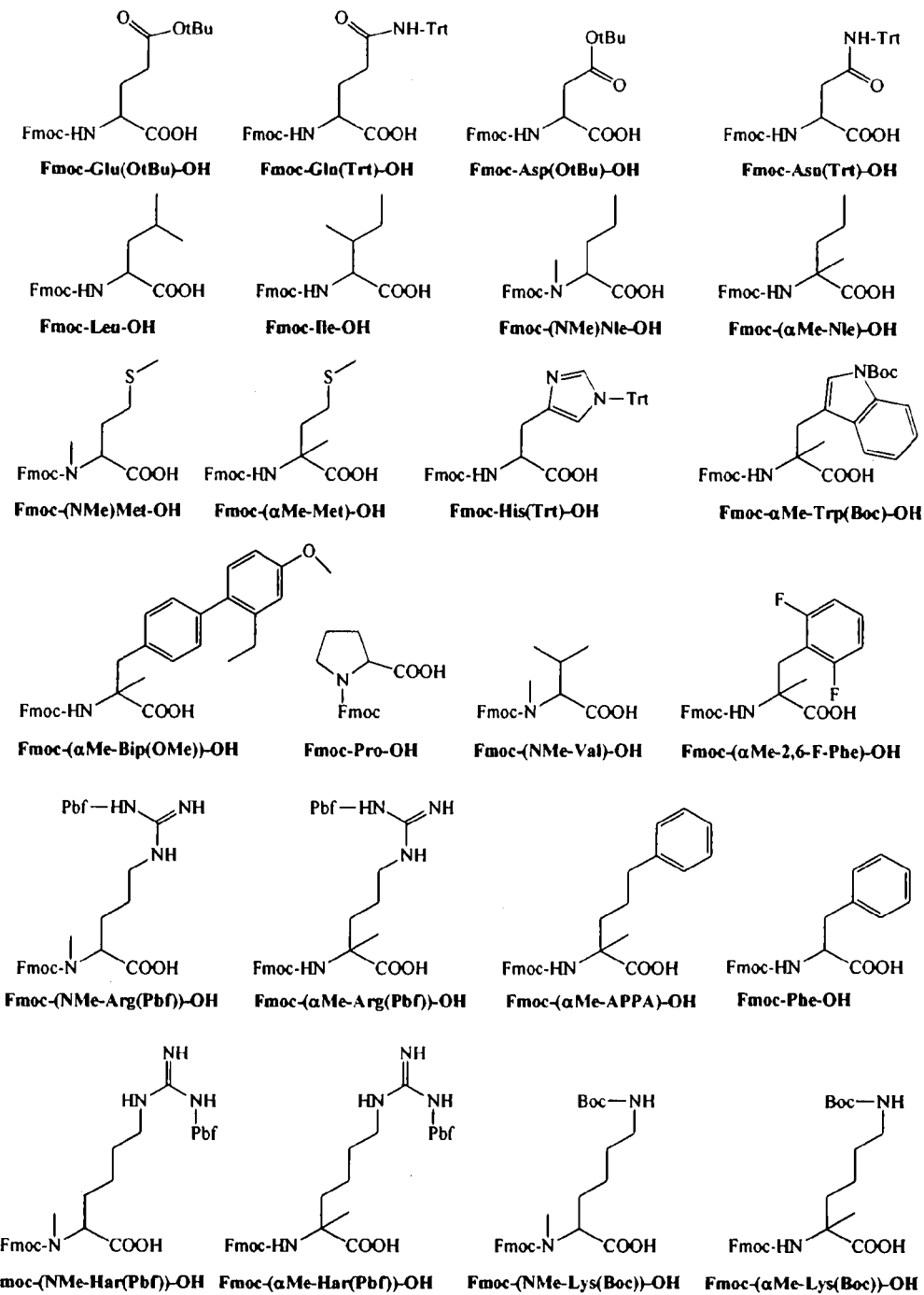
Figure 2 (contd) : Examples of orthogonally protected amino acids used in Fmoc based-solid phase peptide synthesis (SPPS) of short-chain peptides.

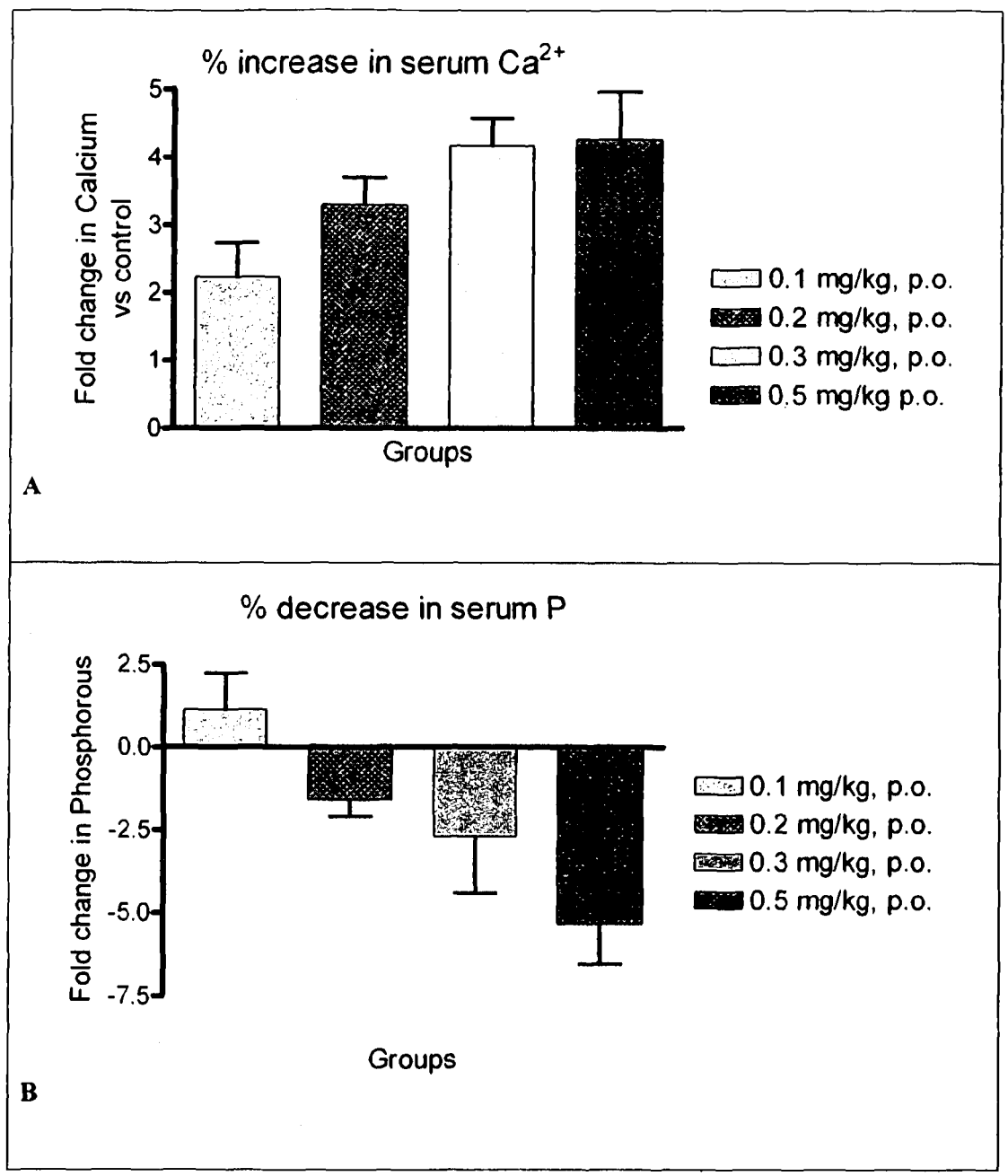
Figure 3: *In vivo* DRC study with Seq. ID No. 111 (Figure A: % increase in serum $Ca^{2+}$ levels; Figure B: % decrease in serum $PO_4$ levels), in OVX Female Rat.

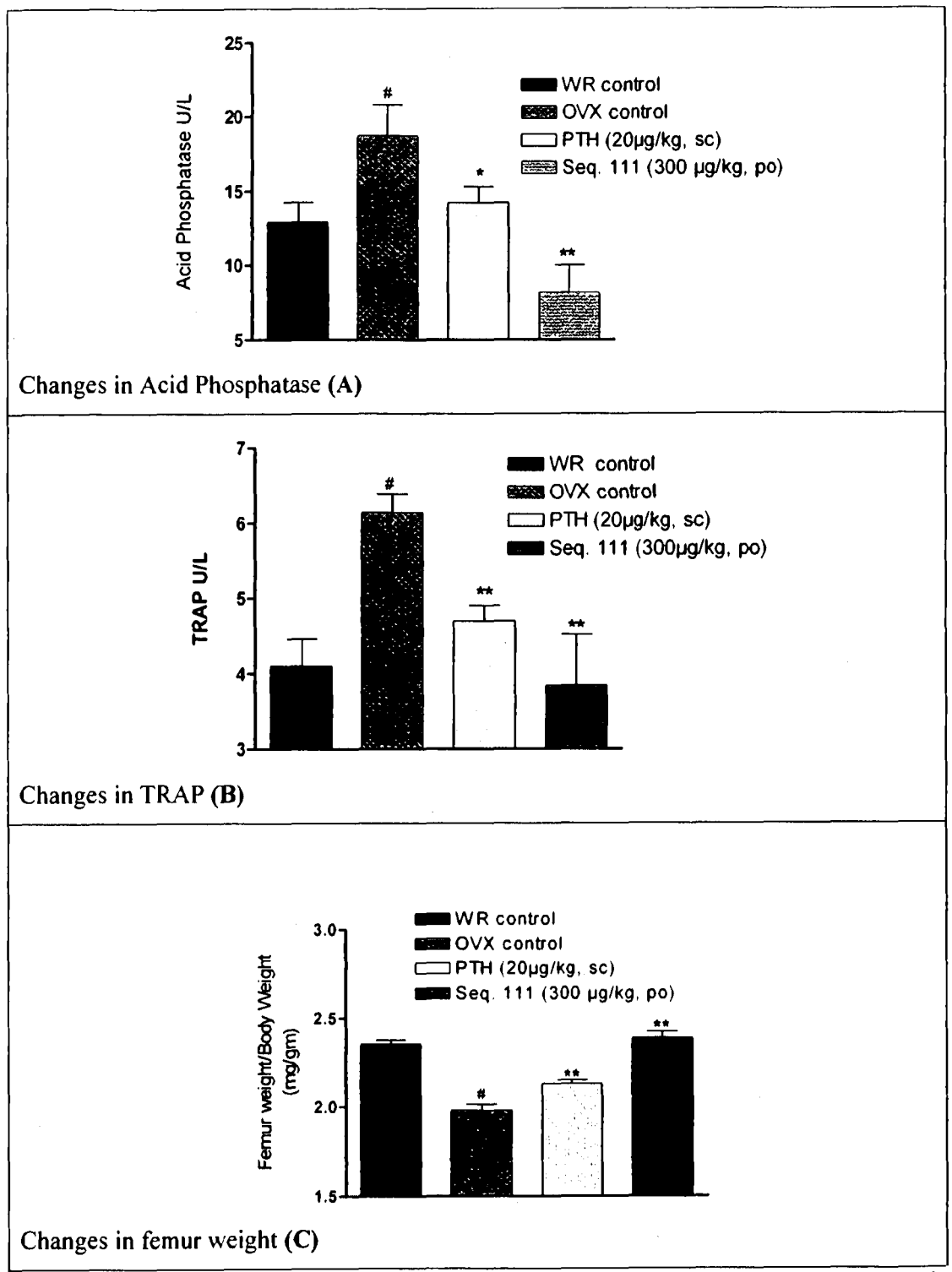
Figure 4: Changes in biochemical parameters and femur weight, in OVX Rat after 6 weeks treatment with Seq. ID No. 111 and PTH(1-34).

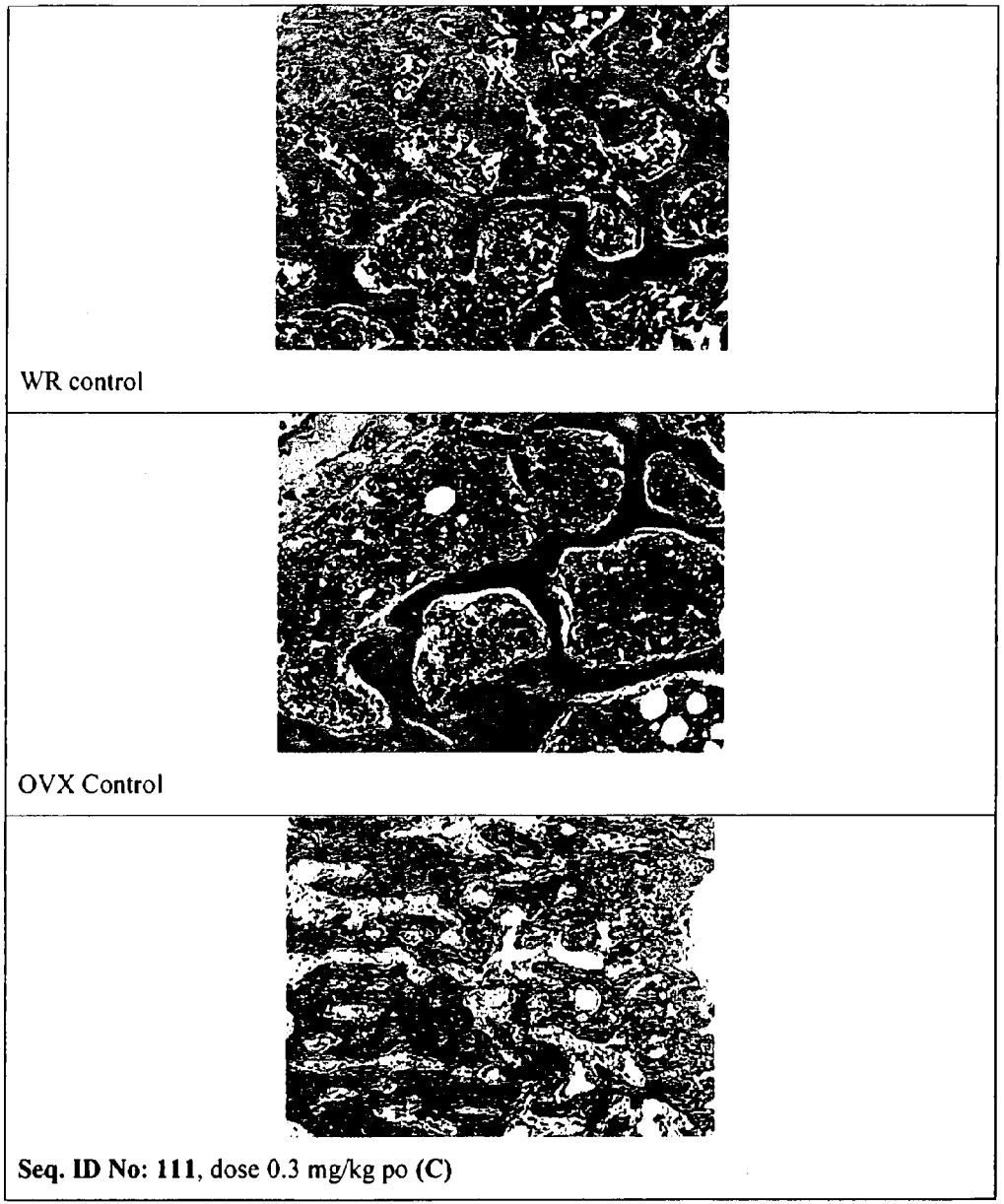
Figure 5: Histological sections of the femur, in OVX rats after 6 weeks treatment with Seq. ID No. 111.

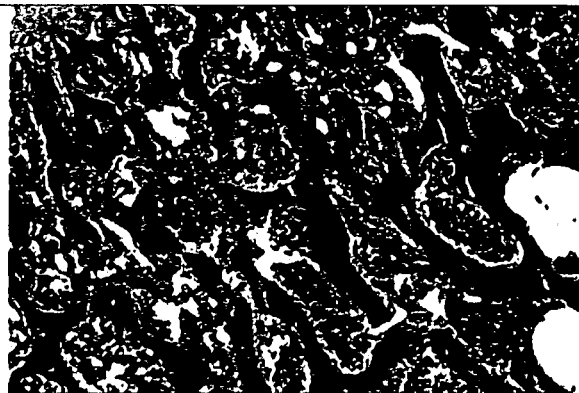
WR control (A)
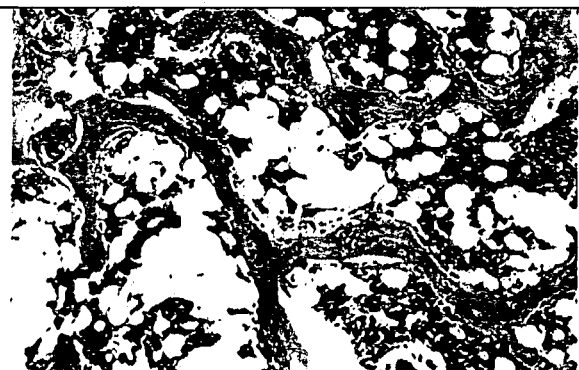
OVX Control (B)
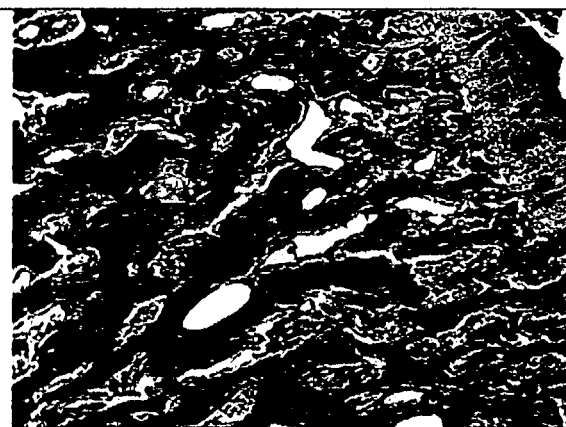
Seq. ID No: 111, dose 0.3 mg/kg po (C)
Figure 6: Histological sections of the tibia in OVX rats after 6 weeks treatment with Seq. ID No. 111.

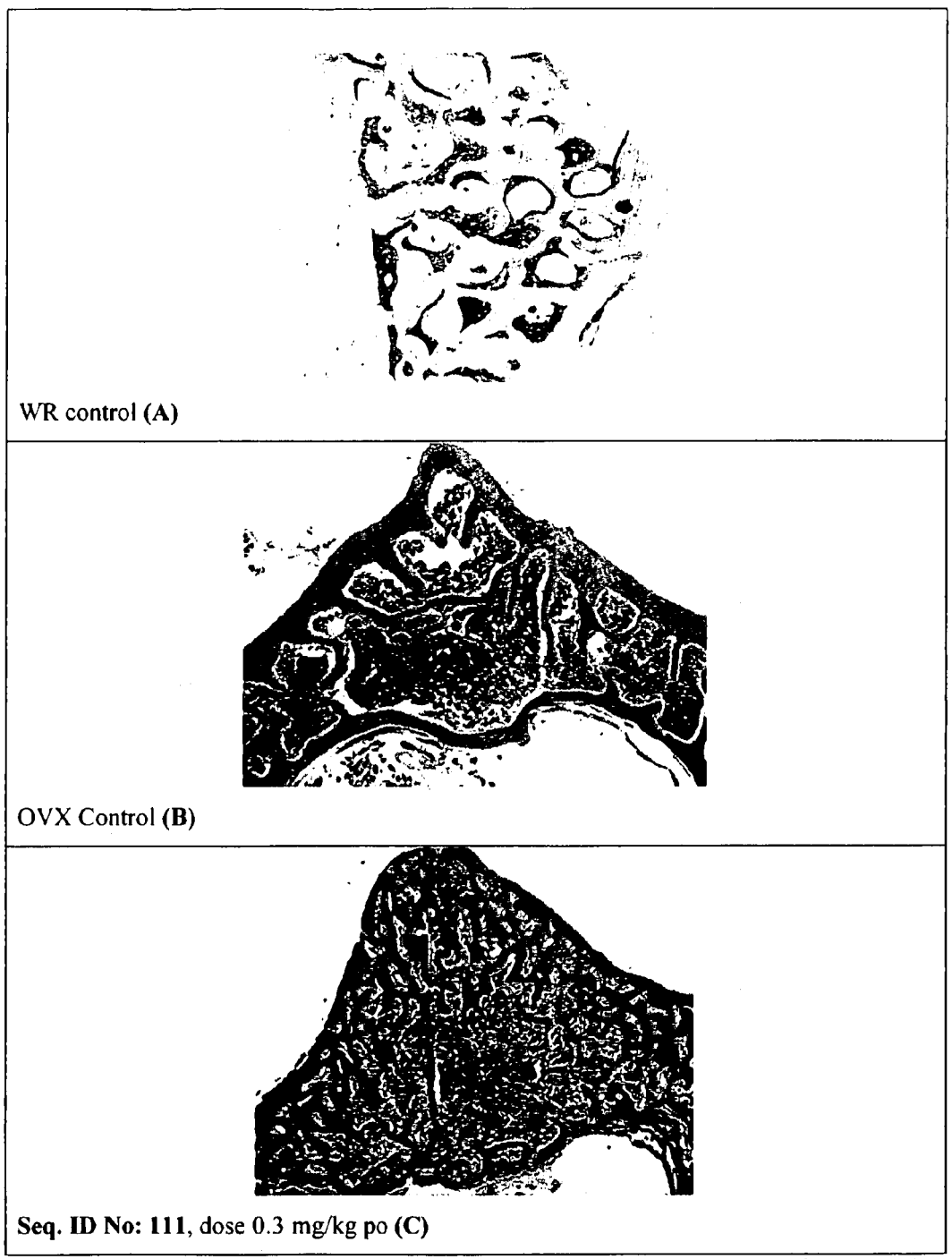
Figure 7: Histological sections of the lumbar vertebrae in OVX rats after 6 weeks treatment with Seq. ID No. 111.

SHORT-CHAIN PEPTIDES AS PARATHYROID HORMONE (PTH) RECEPTOR AGONIST

FIELD OF INVENTION

The present invention relates to novel short-chain peptides as PTH receptor agonist of general formula (I), their pharmaceutically acceptable salts and pharmaceutical compositions containing them.

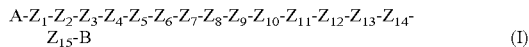

$$A\text{-}Z_1\text{-}Z_2\text{-}Z_3\text{-}Z_4\text{-}Z_5\text{-}Z_6\text{-}Z_7\text{-}Z_8\text{-}Z_9\text{-}Z_{10}\text{-}Z_{11}\text{-}Z_{12}\text{-}Z_{13}\text{-}Z_{14}\text{-}Z_{15}\text{-}B \qquad (I)$$

The present invention also relates to processes for preparing compounds of general formula (I), their pharmaceutically acceptable salts and pharmaceutical compositions containing them.

BACKGROUND TO THE INVENTION

Osteoporosis is a skeletal disorder characterised by diminished bone mass, decreased bone mineral density (BMD), decreased bone strength and associated with an increased risk of bone fracture (Lane J. M., et al., Clin. Orthop. Relat. Res., 372, 2000, 139-150). Osteoporotic fractures most often occur in the vertebrae, hips or the femoral neck. These fractures severely impair the quality of life because of pain, long-lasting immobility and poor recovery. Bone comprises of several different cell types. Osteoblast (bone formation) lays down new bone from the mineral present in the extracellular milieu around the cells. Osteoclasts (bone loss) remove old bones, releasing the minerals compiled within bone back into the extracellular matrix. The balance between adequate new bone being deposited and old bone being removed is what gives bone its extremely beneficial properties. Osteoporosis occurs when the rate of the bone resorption is greater than the rate of bone formation (Seeman E., et al., N. Engl. J. Med., 354(21), 2006, 2250-2261). Postmenopausal estrogen deficiency is the most common cause of osteoporosis in women, as estrogen puts a break on osteoclast lifespan. Other major risk factors in the development of osteoporosis include: low calcium intake, vitamin D deficiency, type-1 diabetes, rheumatoid arthritis, long-term use of medication such as anticonvulsants and corticosteroids and low levels of testosterone in men (Cole Z. A., et al., Curr. Rheumatol. Rep., 10(2), 2008, 92-96; Harvey, N., et al., Cliff. Rheumatol. Rep., 5(1), 2003, 75-81).

Patients with osteoporosis would benefit from new therapies designed to promote fracture repair or from therapies designed to prevent or lessen the fractures associated with the disease (Lindsay R., Lancet, 341(8848), 1993, 801-805). At present, there is no effective cure for osteoporosis, though estrogen, raloxifene (oestrogen receptor modulators), calcitonin and the bisphosphonates (etidronate, alendronate and risedronate) are used to treat the disease with varying levels of success through their action to decrease bone resorption (Recker R. R., J. Clin. Endocrinol. Metab., 1993, 76(1), 14-16).

Native human Parathyroid Hormone (PTH) is an 84 amino acids polypeptide that acts as the most important regulator of calcium homeostasis in the human body through its direct action on bone and kidneys (Kronenberg H. M., Bringhurst F. R., Nussbaum S. R., Jüppner H., Abou-Samra A. B., In Handbook of Experimental Pharmacology, Mundy, G. R., and Martin, T. J., (eds), pp. 185-201, Springer-Verlag, Heidelberg (1993)). PTH synthesis and release from the parathyroid glands are controlled principally by the serum calcium level; a low level stimulates and a high level suppresses both hormone synthesis and release. PTH in-turn, maintains the serum calcium level by directly or indirectly promoting calcium entry into the blood. PTH contributes to net gastrointestinal absorption of calcium by favouring the renal synthesis of the active form of vitamin D. PTH promotes calcium reabsorption from bone, indirectly by stimulating differentiation of the osteoclasts (bone-resorbing cells). Administration of PTH via parenteral route efficiently increases bone mineral density (BMD), bone strength and reduces the incidence of new osteoporotic fractures in osteoporotic patients (Greenspan S. L., et al., Ann. Intern. Med., 146(5), 2007, 326-339; Neer R. M., et al., N. Engl. J. Med., 344, 2001, 1434-1441).

PTH exerts all these effects primarily through its interaction with a cell surface PTH receptor, which is expressed in numerous tissues, most abundantly in kidney, bone and growth plate chondrocytes (Lanske B., et al., Crit. Rev. Eukaryot. Gene Expr., 8, 1998, 297-320). The PTH receptor is homologous in primary structure to a number of other receptors that bind peptide hormones, such as secretin, calcitonin and glucagon; together, these receptors form a distinct family called G-protein coupled receptors (GPCR/GPCRs) family B (Kolakowski L. F., Receptor Channels, 2, 1994, 1-7). The GPCR comprise an extracellular N-terminal domain of 100-160 residues, connected to a juxtamembrane domain (J-domain) of seven membrane-spanning α-helices with intervening loops and a C-terminal tail (Donnelly D., FEBS Letts., 409, 1997, 431-436). The Class B GPCRs are activated by endogenous peptide ligands of intermediate size, typically 30-40 amino acids (Hoare, S. R. J., Drug. Discovery Today, 10, 2005, 423-427). A general mechanism of peptide ligand interaction with class B GPCRs has emerged and is termed as the 'two-domain' model. The C-terminal portion of the peptide binds the N-domain of the receptor, confirm binding of ligand with the receptor and the N-terminal ligand region binds the J-domain, an interaction that activates the receptor and stimulates intracellular signaling (Ji T. H., et al., J. Biol. Chem.; 273, 1988, 17299-17302; Hjorth, S. A., et al., Regulatory Peptides, 64, 1996, 70).

PTH binds to the PTH receptor with affinity in the nM range; the ligand-occupied receptor transmits a signal across the cell membrane to intracellular effector enzymes through a mechanism that involves intermediary heterotrimeric GTP-binding proteins (G proteins). The primary intracellular effector enzyme activated by the PTH receptor in response to PTH peptide is adenylyl cyclase (AC) (Goltzman D., J. Bone Miner. Res., 15(3), 2000, 605-608). Thus PTH induces increase in the second messenger, cyclic adenosine monophosphate (cAMP) which regulates the poorly characterized downstream cellular processes involved in bone remolding (Juppner H., et al., Science, 254, 1991, 1024-1026). Other signalling pathways of this receptor, such as elevation of intracellular calcium, phospholipase C-dependent and independent activation of protein kinase C, have been described. Since PTH regulates blood calcium and the phosphate levels and exhibit potent anabolic (bone-forming) effects, the parathyroid hormone and its derivatives represent potential therapeutic agent for the treatment of osteoporosis (Slovik D. M., et al., J. Bone Miner. Res., 1, 1986, 377-381; Dempster D. W., et al., Endocr. Rev., 14, 1993, 690-709).

Synthetic PTH (1-34) exhibits full bioactivity in most cell-based assay systems, has potent anabolic effects on bone mass in animals and has recently been shown to reduce the risk of bone fracture in postmenopausal osteoporotic women. In human trials on postmenopausal women, daily subcutaneous injections of low doses of PTH (1-34) were shown to result in impressive bone formation in the spine and femoral neck with significant reduction in incidence of vertebral fractures (Neer R. M., et al., N. Engl. J. Med., 344, 2001, 1434-1441; Dempster D. W., et al., Endocr. Rev., 14, 1993, 690-709). These clinical data reveal PTH as one of the most efficacious agents tested for osteoporosis. Under the brand name Forteo (Eli Lilly), PTH (1-34) in the form of teriparatide acetate has been approved for the treatment of osteoporosis.

PTH derivatives include polypeptides that have amino acid substitutions or are truncated relative to the full-length molecule. Both the N and C-terminal truncated forms of PTH (1-34) has been studied. Additionally, amino acid substitutions within the truncated polypeptides have also been investigated. (Azurani A., et al., J. Biol. Chem., 271, 1996, 14931-14936). It has been known that residues in the 15-34 domain of PTH peptide contribute importantly to receptor binding affinity, while N-terminal 1-14 amino acids of PTH peptide are responsible for the activation of receptor (Naussbaum S. R., et al., J. Biol. Chem., 255, 1980, 10183-10187; Gardella T. J., et al., Endocrinology, 132, 1993, 2024-2030; Takasu H., et al., Biochemistry, 38, 1999, 13453-13460; Hoare S. R. J., et al., J. Biol. Chem., 276, 2001, 7741-7753; Luck M. D., et al., Molecular Endocrinology, 13, 1999, 670-680). Truncated PTH (1-34) derivatives such as cyclised PTH (1-17), PTH (1-28) and PTH (1-31) are active in most assay systems and promote bone-formation (Whitfield J. F., et al., J. Bone Miner. Res., 12, 1997, 1246-1252; WO 2007/130113 A2; WO 2008/068487; Whitfield J. F., et al., Calcif. Tissue Int., 56, 1995, 227-231; Rixon R. H., et al., J. Bone Miner. Res., 9, 1994, 1179-1189; Whitfield J. F., et al., Trends Pharmacol. Sci., 16, 1995, 372-386; Whitfield J. F., et al., Calcif. Tissue Int., 58, 1996, 81-87). But these peptides are still too large for efficient non-parenteral delivery. The discovery of an even smaller PTH agonist would be an important advance in the effort to develop new treatments for osteoporosis.

Unfortunately, due to the large molecular weight of PTH peptide, its therapeutic application has been limited, since its synthesis is technically difficult and therefore expensive and the only possible administration mode is the injection route. Moreover, PTH is highly susceptible to protease attack and must be stored at low temperature due to its low stability. In addition to these technical limitations, tolerability is limited by transient mobilization of calcium and hypercalcemia also the toxicological data and in particular the unfavourable results of cancerogenesis studies (dose and treatment duration dependent increased risk of osteosarcoma) induce a cautious use of PTH (1-34) (Vahle J. L., Toxicol. Pathos., 32(4), 2004, 426-438; Whitfield J. F., Medscape Womens Health, 6(5), 2001, 7; Kuijpers G., BMJ, 324(7335), 2002, 435-436). On the other hand, low molecular weight peptides, for instance those consisting of the first 14 or 11 amino acids of PTH (PTH(1-14) and PTH(1-11)), proved to be inactive or exhibited very low biological activity, in animal models (Tregear G. W., et al., Endocrinology, 93, 1973, 1349-1353; Gardella T. J., et al., J. Biol. Chem., 266, 1991, 13141-13146).

Therefore, during last decade, investigation has focused on development of PTH-derived low molecular weight peptides with improved biological profile, preferably orally bioavailable, protease resistant, easy to synthesis and exhibit a greater safety index. Recently, it was found that the activity of low molecular weight peptides can be improved by introducing helix stablising unnatural amino acids at specific positions. For example, PTH(1-11) analogs ([Ala$_3$, Gln$_{10}$, Arg$_{11}$]-PTH (1-11), [Ala$_3$, Gln$_{10}$, Har$_{11}$]-PTH(1-11) and [Aib$_{1,3}$; Gln$_{10}$; Har$_{11}$]-PTH(1-11)) and PTH (1-14) analogs, such as [AC$_5$C$_1$, Aib$_3$, Gln$_{10}$, Har$_{11}$, Ala$_{12}$, Trp$_{14}$]PTH(1-14) stimulate cAMP, in nM range (WO 03/009804; WO 04/093902). Several studies were carried out to find low molecular weight peptides with PTH-like activity (Reidhaar-olson J. F., et al., Mol. Cell. Endocrinology., 160, 2000, 135-147; Shimizu M., et al., J. Biol. Chem., 275, 2000, 21836-21843; Shimizu M., et al., Endocrinology, 142, 2001, 3068-3074; Shimizu N., et al., J. Biol. Chem., 276, 2001, 49003-49012; WO 03/009804). Although short analogues consisting of as little as 11 amino acids (derivatives of first 1-11 residues of PTH peptide, Seq. ID. No. 2) can activate the PTH receptor (in vitro) with low potency (WO 04/067021), however, in animal models (in vivo) bone-anabolic activity of these analogues has not been reported. In conclusion, agonist activity on cAMP-signalling pathway of the PTH receptor (in vitro) alone is not at all predictive for bone-anabolic activity in vivo.

In the present investigation, surprisingly, we found that homologous substitution (derivatives) of N-terminal sequence of PTH (1-34) peptide (first 1-14 or 1-15 residues, Seq. ID. No. 3 and 4) with unnatural amino acids resulted in the identification of novel class of short-chain peptides having potent PTH receptor agonistic activity, more specifically PTH-1 receptor agonistic activity, at varying degree of selectivity. To enhance the duration of action and stability against proteolytic enzyme, we have site-specifically modified the short-chain peptides with unnatural amino acids and succeeded in identifying metabolically stable and highly potent short-chain peptides. Some of the short-chain peptides showed bioavailability even by oral route of administration, while retaining PTH-1 receptor agonistic activities.

PTH (1-34) sequences alignment shown below represents the primary structural relationships:

PTH (1-34):
(Seq. ID No: 1)
$^1$SVSEIQLMHNLGKH$^{14}$LNSMERVEWLRKKLQDVHNF$^{34}$.

PTH (1-11):
(Seq. ID No: 2)
$^1$SVSEIQLMHNL$^{11}$

PTH (1-14):
(Seq. ID No: 3)
$^1$SVSEIQLMHNLGKH$^{14}$

PTH (1-15):
(Seq. ID No: 4)
$^1$SVSEIQLMHNLGKHL$^{15}$

Single-letter abbreviations for amino acids can be found in Zubay, G., Biochemistry $2^{nd}$ ed., 1988, MacMillan Publishing, New York, p. 33.

PRIOR ART

A series of conformationally constrained parathyroid hormone peptide (PTH) analogs and derivatives, have been reported with general formula Xaa1-Xaa11 and/or Xaa1-Xaa14, wherein Xaa1-Xaa11 and/or Xaa1-Xaa14 represent the first 1-11 and/or 1-14 N-terminal residues of PTH peptide (SVSEIQLMHNL; Seq. ID No. 2 and SVSEIQLM-HNLGICH; Seq. ID No. 3), with some analogs wherein Xaa1 and Xaa3 represent either Aib or AC$_5$C, Xaa8 represent Nle; Xaa10 represent Q, Xaa11 represent Har, Xaa12 represent Ala and Xaa14 represent W (WO 03/009804 A2; US 2006/7153951 B2; US 2007/0117157 A1; US 2007/0203071 A1; US 2006/0019902 A1; US 2007/0161569 A1; US 2007/0111946 A1; Gardella T. J., et al., J. Biol. Chem. 2000, 275, 21836-21843; Gardella T. J., et al., Endocrinology, 2001, 142, 3068-3074; Gardella T. J., et al., J. Biol. Chem., 2001, 52, 49003-49012). Recently, some non-peptide PTH agonist are also reported in literature but none of them were found to have potential in in-vivo animal models (US 2007/0099940 A1; WO 2005/077918 A1).

SUMMARY OF THE INVENTION

The present invention describes a group of novel short-chain peptides that function as agonist of the PTH receptor, having different degree of affinity towards the PTH/PTH-1 receptor and useful for the treatment of osteoporosis. These short-chain peptides are defined by the general formula (I) as given below. The short-chain peptides of the present invention are useful for the treatment or prevention of hypoparathyroidism and diseases characterized by bone mass reduction or bone loss, such as osteoporosis, postmenopausal osteoporosis and for stimulating bone repair.

The present invention provides novel short-chain peptides of formula (I), which primarily act as a PTH/PTH-1 receptor agonist. These short-chain peptides exhibit increased metabolic stability against proteolytic enzymes. Most of short-chain peptides were found to be stable in rat plasma up to 24 hours (in vitro), showed increased stability against GIT enzymes such as pepsin and acidic stomach pH and also against liver microsomes (in vitro). Due to increased metabolic stability, other than parenteral route of administration, some of these short-chain peptides can also be delivered by oral route of administration.

PREFERRED EMBODIMENTS

A preferred embodiment of the present invention is to provide novel short-chain peptides of general formula (I), novel intermediates involved in their synthesis, their pharmaceutically acceptable salts and pharmaceutical compositions containing them or their mixtures, suitable for the treatment/mitigation/regulation of bone disorders.

In a further preferred embodiment, is provided pharmaceutical compositions containing short-chain peptides of general formula (I), their pharmaceutically acceptable salts, solvates and their mixtures having pharmaceutically acceptable carriers, solvents, diluents, excipients and other media normally employed in their manufacture.

In a still further preferred embodiment is provided the use of the novel short-chain peptides of the present invention as agents for stimulating new bone formation and treating and/or preventing osteoporosis and related bone disorders, by administering a therapeutically effective and non-toxic amount of the short chain peptides of formula (I), or their pharmaceutically acceptable compositions to the mammals those are in need of such treatment.

Abbreviations Used

The following abbreviations are employed in the examples and elsewhere herein:
Abu(CN)=2-amino-4-cyanobutanoic acid,
Aib=α-Amino-isobutyric acid,
Ala=Alanine,
α-Me-APPA=2-amino-2-methyl-5-phenylpentanoic acid,
α-Me-Bip(OMe)=α-methylated Bip(OMe),
αMe-Har=alpha-methyl-Har,
αMe-K=alpha-methyl-Lys,
αMe-M=alpha-methyl-Met,
αMe-Nle=alpha-methyl-Norleucine,
αMe-Pro=alpha-methyl-Proline,
α-Me-Phe=alpha-methyl-phenylalanine,
α-Me-2F-Phe=alpha-methyl-2-fluorophenylalanine,
α-Me-2,6-F-Phe=alpha-methyl-2,6-difluorophenylalanine,
αMe-R=alpha-methyl-Arg,
αMe-Trp=alpha-methyl-Tryptophan,
αMe-Val=alpha-methyl-Valine,
$AC_3C$=1-amino cyclopropane carboxylic acid,
$AC_5C$=1-amino-cyclopentanecarboxylic acid,
$AC_6C$=1-amino-cyclohexanecarboxylic acid,
ACN=Acetonitrile,
APPA=2-amino-5-phenylpentanoic acid,
Arg=Arginine,
$Arg(NO_2)$=Arginine(Nitro),
Asp=Aspartate,
Asn=Asparagine,
Bn=Benzyl,
Boc=tert-Butoxycarbonyl,
Bip(OMe)=2'-ethyl-4'-methoxy-biphenylalanine,
$Bu^t$=O-tert-butyl group,
cAMP=Adenosine 3',5'-cyclic monophosphate,
Cit=Citrulline,
DCM=Dichloromethane,
DMF=N,N-Dimethylformamide,
DIPCDI=Di-isopropylcarbodiimide,
DIPEA=Diisopropylethylamine,
Et=Ethyl,
$Et_2O$=Diethyl ether,
EtMet=Ethionine,
Fmoc=Fluorenylmethoxycarbonyl,
2F-Phe=2-fluorophenylalanine,
g=Gram (s),
Gly=Glycine,
Glu=Glutamate,
Gln=Glutamine,
Ile=Isoleucine,
h=Hour (s),
His=Histidine,
Har=Homoarginine,
HoCit=Homocitrulline,
HoGlu=Homoglutamic acid,
HoLeu=Homoleucine,
HOBt=1-Hydroxybenzotriazole,
HOAt=7-Aza-hydroxybenzotriazole,
HBTU=2-(1H-benzotriazole-1-yl)-1,1,3,3-tetramethyl aminium hexafluorophosphate,
HPLC=High Performance Liquid Chromatography,
K(Biotin)=Lysine(Biotin),
$K(NO_2)$=Lysine(Nitro),
L=Liter,
LC/MS=Liquid Chromatography/Mass Spectrometry,
Lys=Lysine,
Me=Methyl,
Met=Methionine,
Min=minute (s),
mL=milliliter,
μl=microliter,
mg=milligram (s),
mmol=millimole (s),
MS=Mass Spectrometry,
Nva=Norvaline,
Nle=Norleucine,
(NMe)M=N-methyl-Met,
(NMe)Nle=N-methyl-Nle,
(NMe)K=N-methyl-Lys,
(NMe)R=N-methyl-Arg,
(NMe)Har=N-methyl-Har,
Orn=Ornithine,
$Orn(NO_2)$=Ornithine(Nitro),
po: per-oral administration,
Phe=Phenylalanine,
PTH=Parathyroid Hormone, PTH-1r agonist=Parathyroid Hormone receptor agonist,
PyBOP=Benzotriazole-1-yl-oxy-tris-pyrrolidino-phosphonium hexafluorophosphate,
Pyr=Pyroglutamic acid,
Pro=Proline,
sc=Subcutaneous route of administration,
SPPS=Solid Phase Peptide Synthesis,
SMet=Selenomethionine,
TMS=Trimethylsilyl,
TIPS=Triisopropylsilane,
TFA=Trifluoroacetic acid,
TBTU=2-(1H-benzotriazole-1-yl)-1,1,3,3-tetramethylaminium tetrafluoroborate,
Trt=Trityl group,
Trp=Tryptophan,
Val=Valine,
WR=Wistar Rats.

BRIEF DESCRIPTION OF THE ACCOMPANYING DRAWINGS

FIG. 1: In vitro DRC and $EC_{50}$ determination of PTH(1-34) (FIG. A) and Seq. ID No. 111 (FIG. B), in Rat PTH-1 R assay (agonistic activity, measured by amount of cAMP released).

FIG. 2: Examples of orthogonally protected amino acids used in Fmoc based-solid phase peptide synthesis (SPPS) of short-chain peptides.

FIG. 3: In vivo DRC study with Seq. ID No. 111 (FIG. A: % increase in serum $Ca^{2+}$ levels; FIG. B: % decrease in serum $PO_4$ levels), in OVX Female Rat.

FIG. 4: Changes in biochemical parameters and femur weight, in OVX Rat after 6 weeks treatment with Seq. ID No. 111 and PTH(1-34).

FIG. 5: Histological sections of the femur, in OVX rats after 6 weeks treatment with Seq. ID No. 111.

FIG. 6: Histological sections of the tibia in OVX rats after 6 weeks treatment with Seq. ID No. 111.

FIG. 7: Histological sections of the lumbar vertebrae in OVX rats after 6 weeks treatment with Seq. ID No. 111.

DETAILED DESCRIPTION OF THE INVENTION

In accordance with the present invention, synthetic short-chain peptides having the structural formula (I), which showed PTH-1 receptor agonistic activity, are disclosed. These short-chain peptides exhibit increased metabolic stability to proteolytic cleavage, as most of short-chain peptides were found to be stable in rat plasma up to 24 hours (in vitro), showed increased stability against GIT enzymes such as pepsin and acidic stomach pH and also against liver microsomes (in vitro). Due to increased metabolic stability, some of these short-chain peptides can also be delivered by oral routes of administration, for the treatment/prevention of hypoparathyroidism and diseases characterized by bone mass reduction, such as osteoporosis, postmenopausal osteoporosis and for stimulating bone repair.

The present invention thus discloses novel short-chain peptides as PTH receptor agonist having the following structure (I)

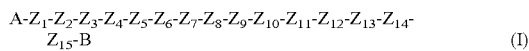
(I)

wherein,
'A' represents the groups —NH—$R_1$ or $R_3$—CO—NH—, wherein $R_1$ represents hydrogen, Biotin, or optionally substituted linear or branched ($C_{1-18}$) alkyl chain, or suitable amino acids such as pyroglutamic acid (Pyr), Pro (P), alpha-methyl-Proline (αMe-P), Val (V), N-methyl-valine (NMe-V), alpha-methyl-Valine (αMe-V), Lys(Biotin), Lys(alkyl), Lys (acetyl); $R_3$ is selected from optionally substituted linear or branched ($C_{1-18}$) alkyl chain, ($C_{1-6}$)alkoxy, ($C_3$-$C_6$) cycloalkyl, aryl, heteroaryl or arylalkyl groups;

In a preferred embodiment, the aryl group is selected from phenyl, napthyl, indanyl, fluorenyl or biphenyl, groups; the heteroaryl group is selected from pyridyl, thienyl, furyl, imidazolyl, benzofuranyl groups; the arylalkyl groups represent groups wherein the aryl group is attached to an alkyl groups as defined elsewhere in the specification.

'B' represents —$COOR_2$, —$CONHR_2$ or $CH_2OR_2$, wherein $R_2$ represents H or suitable amino acids such as Val (V), alpha-methyl-Valine (αMe-V), Lys(Biotin), Lys(alkyl), Lys (acetyl) and the like;

Each of $Z_1$, $Z_3$ & $Z_{12}$ may be same or different and independently represents naturally or unnaturally occurring amino acids selected from the group comprising of Ser (S), alpha-methyl-Serine (αMe-S), Val (V), alpha-methyl-Valine (αMe-V), Pro (P), alpha-methyl-Proline (αMe-P), Gly (G), Ala (A), α-amino-isobutyric acid (Aib), 1-amino cyclopropane carboxylic acid ($AC_3C$), 1-amino-cyclopentanecarboxylic acid ($AC_5C$), 1-amino-cyclohexanecarboxylic acid ($AC_6C$);

$Z_2$ represents either a Val (V) or αMe-Val (αMe-V);

Each of $Z_4$, $Z_6$ & $Z_{10}$, may be same or different and independently represents a naturally or unnaturally occurring amino acid selected from the group comprising of Glu (E), Homoglutamic acid (HoGlu), 2-amino-4-cyanobutanoic acid (Abu(CN)), Asp(D), Asn(N), Gln(Q), Aib;

Each of $Z_5$, $Z_7$ & $Z_9$ may be same or different and independently represents a naturally or unnaturally occurring amino acid selected from the group comprising of Leu (L), Ile (I), Nle (Norleucine), Nva (Norvaline), HoLeu (Homoleucine), Abu(CN), His (H), Phe (F), alpha-methyl-phenylalanine (-α-Me-Phe-), alpha-methyl-2-fluorophenylalanine (-α-Me-2F-Phe-) or alpha-methyl-2,6-difluorophenylalanine (-α-Me-2,6-F-Phe-) or 2-fluorophenylalanine (-2F-Phe-) as below;

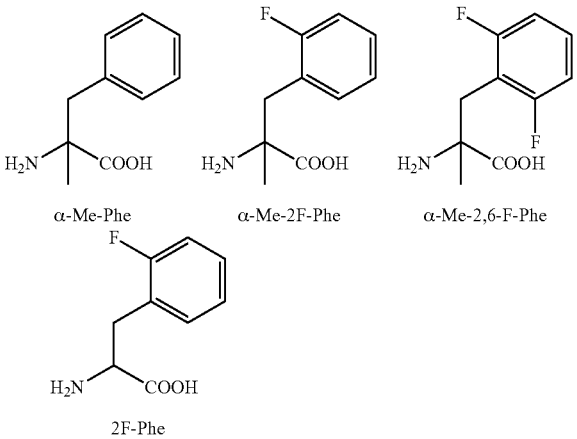

$Z_8$ represents a naturally or unnaturally occurring amino acid selected from the group comprising of Met, N-methyl-Met ((NMe)M), alpha-methyl-Met (αMe-M), alpha-methyl-Valine (αMe-V), Leu, Nle, N-methyl-Nle ((NMe)Nle), alpha-methyl-Norleucine (αMe-Nle), Nva, HoLeu, Ethionine (EtMet), selenomethionine (SMet), Val;

$Z_{11}$ and $Z_{13}$ may be same or different and independently represents a naturally or unnaturally occurring amino acid selected from the group comprising of Aib, Pro (P), αMe-Pro, Lysine (K), Lysine-Biotin (K(Biotin)), Lysine(Nitro); K(NO₂), Arginine (R), Arginine(Nitro); (Arg(NO₂)), Homoarginine (Har), Ornithine (Orn), Ornithine(Nitro); Orn (NO₂), Citrulline (Cit), Homocitrulline (HoCit), Phe (F), alpha-methyl-phenylalanine (-α-Me-Phe-), alpha-methyl-2-fluorophenylalanine (-α-Me-2F-Phe-) or alpha-methyl-2,6-difluorophenylalanine (-α-Me-2,6-F-Phe-) or 2-fluorophenylalanine (-2F-Phe-);

$Z_{14}$ represents a naturally or unnaturally occurring amino acid selected from the group comprising of 2'-ethyl-4'-methoxy-biphenylalanine (Bip(OMe)), α-methylated Bip(OMe) [αMe-Bip(OMe)], αMe-Trp, alpha-methyl-phenylalanine (-α-Me-Phe-), alpha-methyl-2-fluorophenylalanine (-α-Me-2F-Phe-), alpha-methyl-2,6-difluorophenylalanine (-α-Me-2,6-F-Phe-) or 2-fluorophenylalanine (-2F-Phe-) as below:

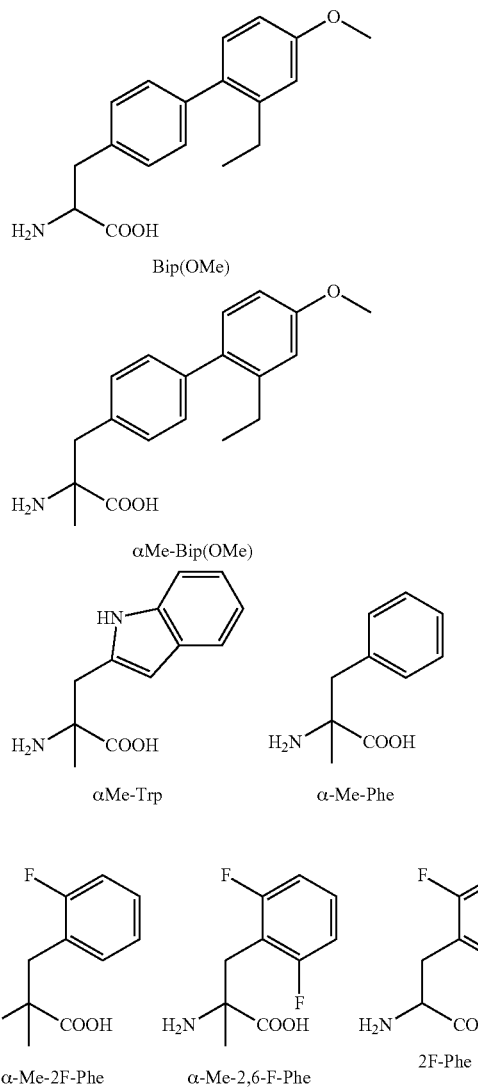

$Z_{15}$ may be present or absent. $Z_{15}$ when present represents a naturally or unnaturally occurring amino acid selected from the group comprising of 2-amino-5-phenylpentanoic acid (APPA) or 2-amino-2-methyl-5-phenylpentanoic acid (α-Me-APPA);

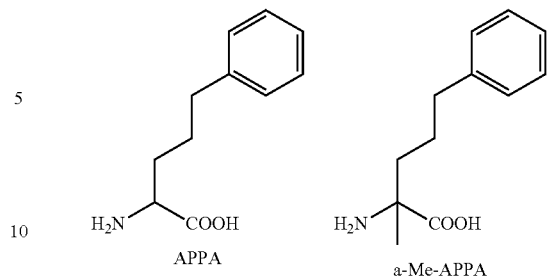

In an embodiment of the present invention are provided modified PTH analogues of formula (I) wherein 'A' represents the groups —NH—$R_1$ or $R_3$—CO—NH—, wherein $R_1$ represents hydrogen, Biotin or suitable amino acids such as pyroglutamic acid (Pyr), Pro (P), Val (V), and all other symbols are as defined earlier;

In another embodiment of the invention is provided compounds of formula (I) wherein, $R_3$ is selected from optionally substituted linear or branched ($C_{1-18}$) alkyl chain and all other symbols are as defined earlier;

In another embodiment of the invention is provided compounds of formula (I) wherein, 'B' represents —$COOR_2$, —$CONHR_2$, wherein $R_2$ represents H or suitable amino acids such as Val (V), alpha-methyl-Valine (αMe-V), Lys(Biotin) and all other symbols are as defined earlier;

In another embodiment of the invention is provided compounds of formula (I) wherein, each of $Z_1$, $Z_3$ & $Z_{12}$ may be same or different and independently represents naturally or unnaturally occurring amino acids selected from the group comprising of Ala (A), α-amino-isobutyric acid (Aib), 1-amino cyclopropane carboxylic acid ($AC_3C$), 1-amino-cyclopentanecarboxylic acid ($AC_5C$), 1-amino-cyclohexanecarboxylic acid ($AC_6C$) and all other symbols are as defined earlier;

In another embodiment of the invention is provided compounds of formula (I) wherein $Z_2$ represents a naturally or unnaturally occurring amino acid selected from the group comprising of Val (V) and all other symbols are as defined earlier;

In a still further embodiment of the invention is provided compounds of formula (I) wherein, each of $Z_4$, $Z_6$ & $Z_{10}$, may be same or different and independently represents a naturally or unnaturally occurring amino acid selected from the group comprising of Glu (E), Gln (Q), Aib and all other symbols are as defined earlier;

In another embodiment of the invention is provided compounds of formula (I) wherein each of $Z_5$, $Z_7$ & $Z_9$ may be same or different and independently represents a naturally or unnaturally occurring amino acid selected from the group comprising of Leu (L), Ile (I), Nle, HoLeu (Homoleucine), His (H), alpha-methyl-2-fluorophenylalanine (-α-Me-2F-Phe-), alpha-methyl-2,6-difluorophenylalanine (-α-Me-2,6-F-Phe-) and all other symbols are as defined earlier;

In another embodiment of the invention is provided compounds of formula (I) wherein $Z_8$ represents a naturally or unnaturally occurring amino acid selected from the group comprising of Met, alpha-methyl-Met (αMe-M), Nle, N-methyl-Nle ((NMe)Nle) and all other symbols are as defined earlier;

In another embodiment of the invention is provided compounds of formula (I) wherein each of $Z_{11}$ and $Z_{13}$ may be same or different and independently represents a naturally or unnaturally occurring amino acid selected from the group comprising of Aib, αMe-Pro, Lysine (K), Lysine-Biotin (K(Biotin)), K(NO$_2$), Arginine (R), Arg(NO$_2$), Homoarginine (Har), Ornithine (Orn), Orn(NO$_2$), Citrulline (Cit), Homocitrulline (HoCit), alpha-methyl-2-fluorophenylalanine (-α-Me-2F-Phe-), alpha-methyl-2,6-difluorophenylalanine (-α-Me-2,6-F-Phe-) and all other symbols are as defined earlier;

In another embodiment of the invention is provided compounds of formula (I) wherein $Z_{14}$ represents a naturally or unnaturally occurring amino acid selected from the group comprising of 2'-ethyl-4'-methoxy-biphenylalanine (Bip (OMe)), α-methylated Bip(OMe) [αMe-Bip(OMe)], alpha-methyl-2-fluorophenylalanine (-α-Me-2F-Phe-), alpha-methyl-2,6-difluorophenylalanine (-α-Me-2,6-F-Phe-) and all other symbols are as defined earlier;

In another embodiment of the invention is provided compounds of formula (I) wherein $Z_{15}$ is present and represents naturally or unnaturally occurring amino acid selected from the group comprising of 2-amino-5-phenylpentanoic acid (APPA) or 2-amino-2-methyl-5-phenylpentanoic acid (α-Me-APPA);

In a preferred embodiment, the present invention discloses modified PTH analogues of formula (I) wherein 'A' represents the groups —NH—R$_1$ or R$_3$—CO—NH—, wherein R$_1$ represents hydrogen, Biotin or suitable amino acids such as pyroglutamic acid (Pyr), Pro (P), Val (V); R$_3$ is selected from optionally substituted linear or branched (C$_{1-18}$) alkyl chain; 'B' represents —COOR$_2$, —CONHR$_2$ wherein R$_2$ is as defined earlier; each of $Z_1$, $Z_3$ & $Z_{12}$ may be same or different and independently represents a naturally or unnaturally occurring amino acids selected from the group comprising of Ala (A), α-amino-isobutyric acid (Aib), 1-amino cyclopropane carboxylic acid (AC$_3$C), 1-amino-cyclopentanecarboxylic acid (AC$_5$C), 1-amino-cyclohexanecarboxylic acid (AC$_6$C); $Z_2$ represents a Val (V); each of $Z_4$, $Z_6$ and $Z_{10}$, may be same or different and independently represents a naturally or unnaturally occurring amino acid selected from the group comprising of Glu (E), Gln (Q), Aib; $Z_5$, $Z_7$ and $Z_9$ may be same or different and independently represents a naturally or unnaturally occurring amino acid selected from the group comprising of Leu (L), Ile (I), Nle, HoLeu (Homoleucine), His (H), alpha-methyl-2-fluorophenylalanine (-α-Me-2F-Phe-), alpha-methyl-2,6-difluorophenylalanine (-α-Me-2,6-F-Phe-); $Z_8$ represents a naturally or unnaturally occurring amino acid selected from the group comprising of Met, alpha-methyl-Met (αMe-M), Nle, N-methyl-Nle ((NMe)Nle); $Z_{11}$ & $Z_{13}$ may be same or different and independently represents a naturally or unnaturally occurring amino acid selected from the group comprising of Aib, αMe-Pro, Lysine (K), Lysine-Biotin (K(Biotin)), K(NO$_2$), Arginine (R), Arg (NO$_2$), Homoarginine (Har), Ornithine (Orn), Orn(NO$_2$), Citrulline (Cit), Homocitrulline (HoCit), alpha-methyl-2-fluorophenylalanine (-α-Me-2F-Phe-), alpha-methyl-2,6-di fluorophenylalanine (-α-Me-2,6-F-Phe-); $Z_{14}$ represents a naturally or unnaturally occurring amino acid selected from the group comprising of 2'-ethyl-4'-methoxy-biphenylalanine (Bip(OMe)), α-methylated Bip(OMe) [αMe-Bip (OMe)], alpha-methyl-2-fluorophenylalanine (-α-Me-2F-Phe-), alpha-methyl-2,6-di fluorophenylalanine (-α-Me-2,6-F-Phe-); $Z_{15}$ when present represents a naturally or unnaturally occurring amino acid selected from the group comprising of 2-amino-5-phenylpentanoic acid (APPA) or 2-amino-2-methyl-5-phenylpentanoic acid (α-Me-APPA).

The substituents on any of the groups defined above may be selected from hydroxyl, oxo, halo, thio, nitro, amino, alkyl, alkoxy, haloalkyl or haloalkoxy groups;

The term 'natural amino acids' indicates all those twenty amino acids, which are present in nature.

The term 'unnatural amino acids' or 'non-natural amino acids' preferably represents either replacement of L-amino acids with corresponding D-amino acids such as replacement of L-Ala with D-Ala and the like or suitable modifications of the L or D amino acids, amino alkyl acids, either by α-alkylation such as substitution of Ala with α-methyl Ala (Aib), replacement of Met with α-methyl Met;
substitution on the side chain of amino acid such as substitution of aromatic amino acid side chain with halogen, (C$_1$-C$_3$) alkyl, aryl groups, more specifically the replacement of Phe with halo Phe;

The various groups, radicals and substituents used anywhere in the specification are described in the following paragraphs.

The term "alkyl" used herein, either alone or in combination with other radicals, denotes a linear or branched radical containing one to eighteen carbons, such as methyl, ethyl, n-propyl, iso-propyl, n-butyl, sec-butyl, tert-butyl, amyl, t-amyl, n-pentyl, n-hexyl, iso-hexyl, heptyl, octyl, decyl, tetradecyl, octadecyl and the like.

The term "cycloalkyl" used herein, either alone or in combination with other radicals, denotes a radical containing three to seven carbons, such as cyclopropyl, cyclobutyl, cyclopentyl, cyclohexyl, cycloheptyl and the like.

Unless otherwise indicated, the term 'amino acid' as employed herein alone or as part of another group includes, without limitation, an amino group and a carboxyl group linked to the same carbon, referred to as 'α' carbon.

The absolute 'S' configuration at the 'α' carbon is commonly referred to as the 'L' or natural configuration. The 'R' configuration at the 'α' carbon is commonly referred to as the 'D' amino acid. In the case where both the 'α-substituents' is equal, such as hydrogen or methyl, the amino acids are Gly or Aib and are not chiral.

While the invention has been primarily exemplified in relation to short-chain peptides, it will also be understood that the peptide linkage between the residues may be replaced by a non-peptide bond provided that the ability to mimic PTH agonist activity is retained. The person skilled in the art will be aware of such suitable modifications, such as thioamide bond formation, N-methylation of amide bonds and the like.

Sequences encompassing conservative substitutions of amino acids are also within the scope of the invention, provided that the biological activity is retained.

It is to be clearly understood that the compounds of the invention include peptide amides and non-amides and peptide analogues, including but not limited to the following:
a) compounds in which one or more amino acids is replaced by its corresponding D-amino acid. The skilled person will be aware that retro-inverso amino acid sequences can be synthesised by standard methods; see for example, Chorev M., Acc. Chem. Res., 26, 1993, 266-273;
b) peptidomimetic compounds, in which the peptide bond is replaced by a structure more resistant to metabolic degradation. See for example, Olson G. L., et al., J. Med. Chem., 36(21), 1993, 3039-3049 and
c) compounds in which individual amino acids are replaced by analogous structures for example Ala with Aib; Met with α-Me-Met.

In general, the use of such alternative structures can provide significantly longer half-life in the body, since they are more resistant to breakdown under physiological conditions or to improve bioavailability.

Throughout the description the conventional one-letter and three-letter code for natural amino acids are used as well as generally acceptable three-letter codes for other unnatural amino acids such as Har (homoarginine), Nle (norleucine), α-amino isobutanoic acid (Aib) are used.

The term 'PTH receptor modulator or agonist' refers to a compound that acts at the PTH-1 and/or PTH-2 receptor to alter its ability to regulate downstream signaling events, such as cAMP production. Example of receptor modulators includes agonist, partial agonist, inverse agonist and allosteric potentiators.

In accordance with the present invention, the synthetic isolated short-chain peptides described herein primarily acts as PTH receptor agonists. These synthetic short-chain peptides exhibit desirable in vitro PTH receptor agonist activity in UMR-106 cells, in the range of 1-1000 nM concentration. PTH receptor agonistic activity is assessed by estimation of amount of cAMP released by the test compounds. Some of the short-chain peptides prepared showed increase in BMD and/or bone strength, when tested in vivo, in OVX rat model, thus making them ideal therapeutic candidates for the treatment and prevention of osteoporosis. These new classes of short-chain peptides can be administered by oral or other non-invasive routes or parenteral routes of administration.

The present invention provides short-chain peptides of formula (I) pharmaceutical compositions employing such short-chain peptides either alone or in combination and for methods of using such short-chain peptides. In particular, the present invention provides a pharmaceutical composition comprising a therapeutically effective amount of short-chain peptides of formula (I), alone or in combination(s), with a pharmaceutically acceptable carrier. Further provided is a method for treating or delaying the progression or onset of osteoporosis, especially primary osteoporosis, endocrine osteoporosis, postmenopausal osteoporosis, hereditary and congentional forms of osteoporosis, wherein, therapeutically effective amount of short-chain peptides of formula (I) or their combination(s) can be administered to a mammal, example, human and a patient in need of treatment.

Preparation of the Short-Chain Peptides:

Several synthetic routes can be employed to prepare the short-chain peptides of the present invention well known to one skilled in the art of peptide synthesis. The short-chain peptides of formula (I), where all symbols are as defined earlier can be synthesized using the methods described below, together with conventional techniques known to those skilled in the art of peptide synthesis, or variations thereon as appreciated by those skilled in the art. Referred methods include, but not limited to those described below.

The short-chain peptides thereof described herein may be produced by chemical synthesis using suitable variations of both the solution-phase (preferably, using Boc-chemistry; M. Bodansky, A. Bodansky, "The practice of peptide synthesis", Springer-Verlag, Berlim, 1984; E. Gross, J. Meinhofer, "The peptide synthesis, analysis, biology", Vol. 1, Academic Press, London, 1979) and or solid-phase techniques, such as those described in G. Barany & R. B. Merrifield, "The peptides: Analysis, synthesis, Biology"; Volume 2—"Special methods in peptide synthesis, Part. A", pp. 3-284, E. Gross & J. Meienhofer, Eds., Academic Press, New York, 1980; and in J. M. Stewart and J. D. Young, "Solid-phase peptide synthesis" 2nd Ed., Pierce chemical Co., Rockford, Il, 1984.

The preferred strategy for preparing the short-chain peptides of this invention is based on the use of Fmoc-based SPPS approach, wherein Fmoc (9-fluorenylmethoxycarbonyl) group is used for temporary protection of the α-amino group, in combination with the acid labile protecting groups, such as tert-butoxycarbonyl (Boc), tert-butyl (Bu$^t$), Trityl (Trt) groups (FIG. 2), for temporary protection of the amino acid side chains, if present (see for example E. Atherton & R. C. Sheppard, "The Fluorenylmethoxycarbonyl amino protecting group", in "The peptides: Analysis, synthesis, Biology"; Volume 9—"Special methods in peptide synthesis, Part C", pp. 1-38, S. Undenfriend & J. Meienhofer, Eds., Academic Press, San Diego, 1987).

The short-chain peptides can be synthesized in a stepwise manner on an insoluble polymer support (resin), starting form the C-terminus of the peptide. In an embodiment, the synthesis is initiated by appending the C-terminal amino acid of the peptide to the resin through formation of an amide, ester or ether linkage. This allows the eventual release of the resulting peptide as a C-terminal amide, carboxylic acid or alcohol, respectively.

In the Fmoc-based SPPS, the C-terminal amino acid and all other amino acids used in the synthesis are required to have their α-amino groups and side chain functionalities (if present) differentially protected (orthogonal protection), such that the α-amino protecting group may be selectively removed during the synthesis, using suitable base such as 20% piperidine solution, without any premature cleavage of peptide from resin or deprotection of side chain protecting groups, usually protected with the acid labile protecting groups.

The coupling of an amino acid is performed by activation of its carboxyl group as an active ester and reaction thereof with unblocked α-amino group of the N-terminal amino acid appended to the resin. After every coupling and deprotection, peptidyl-resin was washed with the excess of solvents, such as DMF, DCM and diethyl ether. The sequence of α-amino group deprotection and coupling is repeated until the desired peptide sequence is assembled (Scheme 1). The peptide is then cleaved from the resin with concomitant deprotection of the side chain functionalities, using an appropriate cleavage mixture, usually in the presence of appropriate scavengers to limit side reactions. The resulting peptide is finally purified by reverse phase HPLC.

The synthesis of the peptidyl-resins required as precursors to the final peptides utilizes commercially available cross-linked polystyrene polymer resins (Novabiochem, San Diego, Calif.). Preferred for use in this invention is Fmoc-PAL-PEG-PS resin, 4-(2',4'-dimethoxyphenyl-Fmoc-aminomethyl)-phenoxyacetyl-p-methyl benzhydrylamine resin (Fmoc-Rink amide MBHA resin), 2-chloro-Trityl-chloride resin or p-benzyloxybenzyl alcohol resin (HMP resin) to which the C-terminal amino acid may or may not be already attached. If the C-terminal amino acid is not attached, its attachment may be achieved by HOBt active ester of the Fmoc-protected amino acid formed by its reaction with DIPCDI. In case of 2-Chloro-trityl resin, coupling of first Fmoc-protected amino acid was achieved, using DIPEA. For the assembly of next amino acid, N-terminal protection of peptidyl resin was selectively deprotected using 10-20% piperidine solution. After every coupling and deprotection, excess of amino acids and coupling reagents were removed by washing with DMF, DCM and ether. Coupling of the subsequent amino acids can be accomplished using HOBt or HOAT active esters produced from DIPCDI/HOBt or DIPCDI/HOAT, respectively. In case of some difficult coupling, especially coupling of those amino acids, which are hydrophobic or amino acids with bulky side chain protection; complete coupling can be achieved using a combination of highly efficient coupling agents such as HBTU, PyBOP or TBTU, with additives such as DIPEA.

The synthesis of the short-chain peptides described herein can be carried out by using batchwise or continuous flow peptide synthesis apparatus, such as CS-Bio or AAPPTEC peptide synthesizer, utilizing the Fmoc/t-butyl protection strategy. The non-natural non-commercial amino acids present at different position were incorporated into the peptide chain, using one or more methods known in the art. In one approach, Fmoc-protected non-natural amino acid was prepared in solution, using appropriate literature procedures. For example, the Fmoc-protected APPA analogs, described above, were prepared from L-pyroglutamic acid, in good enantiomeric purity, using modified literature procedure (Betsbrugge J. V., et al., Tetrahedron, 54, 1988, 1753-1762).

The Fmoc-protected α-methylated amino acids were prepared using asymmetric Strecker synthesis (Boesten, W. H. J., et al., Org. Lett., 3(8), 2001, 1121-1124; Cativiela C., Diaz-de-villegas M. D., Tetrahedran Asymmetry, 9, 1988, 3517-3599). The resulting derivative was then used in the step-wise synthesis of the peptide. Alternatively, the required non-natural amino acid was built on the resin directly using synthetic organic chemistry procedures and a linear peptide chain were build.

The peptide-resin precursors for their respective short-chain peptides may be cleaved and deprotected using suitable variations of any of the standard cleavage procedures described in the literature (King D. S., et al., Int. J. Peptide Protein Res., 1990, 36, 255-266). A preferred method for use in this invention is the use of TFA cleavage mixture, in the presence of water and TIPS as scavengers. Typically, the peptidyl-resin was incubated in TFA/Water/TIPS (95:2.5:2.5) for 1.5-4 hrs at room temperature. The cleaved resin is then filtered off and the TFA solution is concentrated or dried under reduced pressure. The resulting crude peptide is either precipitated or washed with $Et_2O$ or is re-dissolved directly into DMF or 50% aqueous acetic acid for purification by preparative HPLC.

Short-chain peptides with the desired purity can be obtained by purification using preparative HPLC. The solution of crude peptide is injected into a semi-Prep column (Luna 10μ; $C_{18}$; 100 A°), dimension 250×50 mm and eluted with a linear gradient of ACN in water, both buffered with 0.1% TFA, using a flow rate of 40 mL/min with effluent monitoring by PDA detector at 220 nm. The structures of the purified short-chain peptides can be confirmed by Electro-spray Mass Spectroscopy (ES-MS) analysis.

All the peptide prepared were isolated as trifluoro-acetate salt, with TFA as a counter ion, after the Prep-HPLC purification. However, some peptides were subjected for desalting, by passing through a suitable ion exchange resin bed, preferably through anion-exchange resin Dowex SBR P(Cl) or an equivalent basic anion-exchange resin. In some cases, TFA counter ions were replaced with acetate ions, by passing through suitable ion-exchange resin, eluted with dilute acetic acid buffer. For the preparation of the hydrochloride salt of peptides, in the last stage of the manufacturing, selected peptides, with the acetate salt was treated with 4 M HCl. The resulting solution was filtered through a membrane filter (0.2 μm) and subsequently lyophilized to yield the white to off-white HCl salt. Following similar techniques and/or such suitable modifications, which are well within the scope of persons skilled in the art, other suitable pharmaceutically acceptable salts of the short-chain peptides of the present invention were prepared.

General Method of Preparation of Short-Chain Peptides, Using SPPS Approach:

Assembly of Short-Chain Peptides on Resin:

Sufficient quantity (50-100 mg) of Fmoc-PAL-PEG-PS resin or Fmoc-Rink amide MBHA resin, loading: 0.5-0.6 mmol/g was swelled in DMF (1-10 mL/100 mg of resin) for 2-10 minutes. The Fmoc-group on resin was removed by incubation of resin with 10-30% piperidine in DMF (10-30 mL/100 mg of resin), for 10-30 minutes. Deprotected resin was filtered and washed excess of DMF, DCM and ether (50 mL×4). Washed resin was incubated in freshly distilled DMF (1 mL/100 mg of resin), under nitrogen atmosphere for 5 minutes. A 0.5 M solution of first Fmoc-protected amino acid (1-3 eq.), pre-activated with HOBt (1-3 eq.) and DIPCDI (1-2 eq.) in DMF was added to the resin, and the resin was then shaken for 1-3 hrs, under nitrogen atmosphere. Coupling completion was monitored using a qualitative ninhydrin test. After the coupling of first amino acid, the resin was washed with DMF, DCM and Diethyl ether (50 mL×4). For the coupling of next amino acid, firstly, the Fmoc-protection on first amino acid, coupled with resin was deprotected, using a 10-20% piperidine solution, followed by the coupling the Fmoc-protected second amino acid, using a suitable coupling agents, and as described above.

The repeated cycles of deprotection, washing, coupling and washing were performed until the desired peptide chain was assembled on resin, as per general Scheme 1 above. Finally, the Fmoc-protected peptidyl-resin prepared above was deprotected by 20% piperidine treatment as described above and the peptidyl-resins were washed with DMF, DCM and Diethyl ether (50 mL×4). Resin containing desired peptide was dried under nitrogen pressure for 10-15 minutes and subjected for cleavage/deprotection.

Using above protocol and suitable variations thereof which are within the scope of a person skilled in the art, the short-chain peptides designed in the present invention were prepared, using Fmoc-SPPS approach. Finally, resin bound short-chain peptides were cleaved and deprotected, purified and characterized using protocol described in next section.

Representative Example of Automated Solid Phase Synthesis of Peptide Sequence ID. No. 18: $H_2N$-$(AC_5C)$-V-$(AC_5C)$-EIQLMHQ-Har-(αMe-Pro)-K-(α-Me-Phe)-$CONH_2$.

The linear short-chain peptide, $H_2N$-$(AC_5C)$-V-$(AC_5C)$-EIQLMHQ-Har-(αMe-Pro)-K-(α-Me-Phe)-PAL-PEG-PS was assembled on an automated CS-Bio 536 PepSynthe-siser™ using Fmoc solid phase peptide synthesis (SPPS) approach (Scheme 2). The Fmoc amino acids and the 2-(1H-Benzotriazol-1-yl)-1,1,3,3-tetramethyluroniumtetrafluo-roborate (TBTU) were packed together in vials and positioned in the amino acid module of the synthesizer.

Scheme 1: General Scheme for Fmoc-Based SPPS

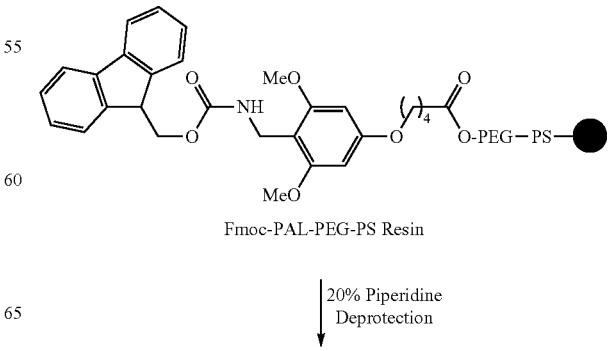

Fmoc-PAL-PEG-PS Resin

20% Piperidine Deprotection

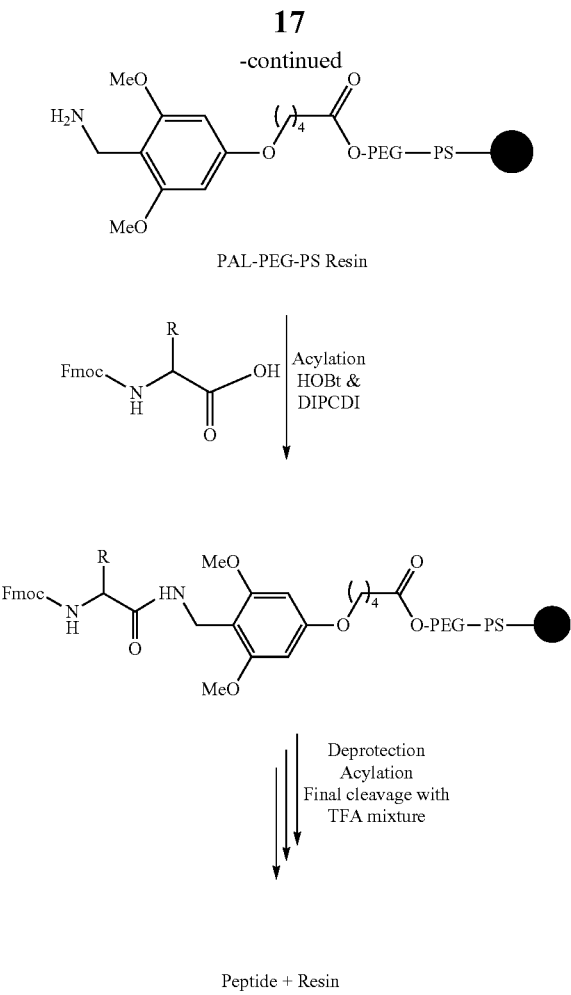

PAL-PEG-PS Resin

Peptide + Resin

A stock solution of diisopropylethylamine (DIPEA; 0.9 M) and DMF were stored in reagent bottles, under dry nitrogen atmosphere. The resin, Fmoc-PAL-PEG-PS (0.38 mmol/g; 1 g) was dried over $P_2O_5$, in vacuo (1 hr) and swollen in freshly distilled DMF (5 mL). The swollen resin was slurry packed into a glass column and positioned in the synthesizer. All the synthetic cycles were carried out at a flow rate of 5 mL min$^{-1}$, Table 1. The resin was washed with freshly distilled DMF for 10 minutes. Deprotection of Fmoc group was performed with 20% piperidine in DMF for 10 minutes and the deprotection was monitored by UV detection of the column effluent at 304 nm.

TABLE 1

Automated cycles for solid phase peptide synthesis

| Step | Function | Reagent/Solvent | Number of cycles | Time (Minute) |
|---|---|---|---|---|
| 1 | Wash | Dimethylformamide (DMF) | 1 | 10 |
| 2 | Deprotection | 20% piperidine in DMF | 2 | 15 |
| 3 | Wash | DMF | 3 | 15 |
| 4 | Acylation | Amino acid; TBTU and diisopropylethylamine (in DMF) | Recycle | 120 |
| 5 | Wash | Dimethylformamide | 4 | 10 |

Excess piperidine was removed by three auxiliary wash cycles and a distilled DMF wash cycle, with each cycle of 15 minutes. The amino group was treated with Fmoc-amino acid (4 equivalent), preactivated with TBTU (3.9 equivalent) in the presence of DIPEA (8 equivalent) and recycled for 120 minutes. The excess amino acid and soluble by-products were removed from column and loop by four auxiliary wash cycles and distilled DMF wash cycles, with each cycle of 10 minutes. Furthermore, synthetic cycles (deprotection, wash, acylation and wash) were repeated for complete assembly of linear peptide. Final deprotection cycle was performed with 20% piperidine in DMF for 15 minutes to remove the terminal Fmoc group, followed by wash cycle (10×4 minutes). Completed peptide-resin was filtered through sintered glass filter, washed three times successively with DMF, DCM, methanol, DMF and diethyl ether (100 mL each). Peptide-resin was dried in vacuo over $P_2O_5$ (2 hr) and stored at −20° C.

Scheme 2: SPPS of Seq. ID. No. 18

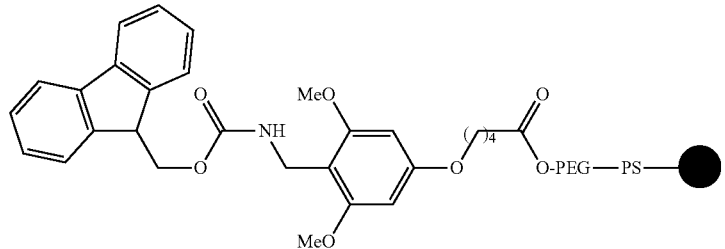

Fmoc-PAL-PEG-PS Resin

1) Piperidine (Fmoc deprotection)
2) Fmoc-α-Me-Phe-OH (4 eq.); DMF; TBTU (3.9 eq.); DIPEA (8 eq); 2 h
3) Washing with DMF and DCM
4) Repeat step 1-3, with following amino acids:
  Fmoc-Lys(Boc)-OH
  Fmoc-α-Me-Pro-OH
  Fmoc-Har(Pbf)-OH
  Fmoc-Gln(Trt)-OH
  Fmoc-His(Trt)-OH
  Fmoc-Met-OH
  Fmoc-Leu-OH
  Fmoc-Gln(Trt)-OH
  Fmoc-Ile-OH
  Fmoc-Glu(OtBu)-OH
  Fmoc-AC$_5$C-OH
  Fmoc-Val-OH
  Fmoc-AC$_5$C-OH
5) Piperidine (Fmoc deprotection)
6) TFA cleavage
7) RP-HPLC purification

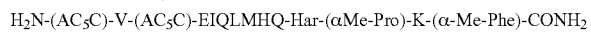

H$_2$N-(AC$_5$C)-V-(AC$_5$C)-EIQLMHQ-Har-(αMe-Pro)-K-(α-Me-Phe)-CONH$_2$ (Seq. ID. No. 18)

Ninhydrin resin test was carried out to check the N-terminal free amino group of resin bound peptide. Appearance of blue-purple colouration of the solution and the resin beads indicates the presence of free amino group on resin bound peptide and was considered to be a positive test.

Small-scale cleavage was carried out to assess the purity of resin bound peptide. The dried Peptide-resin (ca 10-mg) was treated with mixture (1 mL) of TFA, water, triisopropylsilane (95:2.5:2.5 v/v), for 90 minutes at room temperature with gentle occasional swirling. The resin was filtered, washed thoroughly with neat TFA (1 mL) and the entire filtrate was evaporated under reduced pressure. Residual TFA was azeotroped three times with diethyl ether (2 mL). Residue obtained was suspended in distilled water (2 mL) and the aqueous layer was extracted three times with diethyl ether (3 mL). The aqueous layer was separated and freeze-dried to yield the crude peptide H$_2$N-(AC$_5$C)-V-(AC$_5$C)-EIQLMHQ-Har-(αMe-Pro)-K-(α-Me-Phe)-CONH$_2$. The lyophilised peptide H$_2$N-(AC$_5$C)-V-(AC$_5$C)-EIQLMHQ-Har-(αMe-Pro)-K-(α-Me-Phe)-CONH$_2$ was dissolved in 0.1% aqueous TFA (ca 1 mg/1 mL) and its purity was analyzed by analytical RP-HPLC and characterized by electrospray ionisation mass spectrometry (ESI-MS). Percent purity: 90% (crude peptide). ESI-MS; Calcd. for H$_2$N-(AC$_5$C)-V-(AC$_5$C)-EIQLMHQ-Har-(αMe-Pro)-K-(α-Me-Phe)-CONH$_2$: 1790 (M$^+$), 1812 (M+Na$^+$) and 1828 (M+K$^+$). Found (m/z): 1790 (M$^+$), 1812 (M+Na$^+$) and 1828 (M+K$^+$).

Using above protocol and suitable variations thereof which are within the scope of a person skilled in the art, the short-chain peptides designed in the present invention were prepared, using Fmoc-SPPS approach. Furthermore, resin bound short-chain peptides were cleaved and deprotected, purified and characterized using following protocol.

Cleavage and Deprotection:

The desired short-chain peptides were cleaved and deprotected from their respective peptidyl-resins by treatment with TFA cleavage mixture as follows. A solution of TFA/Water/Triisopropylsilane (95:2.5:2.5) (10 mL/100 mg of peptidyl-resin) was added to peptidyl-resins and the mixture was kept at room temperature with occasional starring. The resin was filtered, washed with a cleavage mixture and the combined filtrate was evaporated to dryness. Residue obtained was dissolved in 10 mL of water and the aqueous layer was extracted 3 times with ether (20 mL each) and finally the aqueous layer was freeze-dried. Crude peptide obtained after freeze-drying was purified by preparative HPLC as follows:

Preparative HPLC Purification of the Crude Short-Chain Peptides:

Preparative HPLC was carried out on a Shimadzu LC-8A liquid chromatograph. A solution of crude peptide dissolved in DMF or water was injected into a semi-Prep column (Luna 10μ; C$_{18}$; 100 A$^o$), dimension 250×50 mm and eluted with a linear gradient of ACN in water, both buffered with 0.1% TFA, using a flow rate of 15-50 mL/min, with effluent monitoring by PDA detector at 220 nm. A typical gradient of 20% to 70% of water-ACN mixture, buffered with 0.1% TFA was used, over a period of 50 minutes, with 1% gradient change per minute. The desired product eluted were collected in a single 10-20 mL fraction and pure short-chain peptides were obtained as amorphous white powders by lyophilisation of respective HPLC fractions.

HPLC Analysis of the Purified Short-Chain Peptides

After purification by preparative HPLC as described above, each peptide was analyzed by analytical RP-HPLC on a Shimadzu LC-LOAD analytical HPLC system. For analytical HPLC analysis of short-chain peptides, Luna 5μ; C$_{18}$; 100 A$^o$, dimension 250×4.6 mm column was used, with a linear gradient of 0.1% TFA and ACN buffer and the acquisition of chromatogram was carried out at 220 nm, using a PDA detector.

Characterization by Mass Spectrometry

Each peptide was characterized by electrospray ionisation mass spectrometry (ESI-MS), either in flow injection or LC/MS mode. Triple quadrupole mass spectrometers (API-3000 (MDS-SCIES, Canada) was used in all analyses in positive and negative ion electrospray mode. Full scan data was acquired over the mass range of quadrupole, operated at unit resolution. In all cases, the experimentally measured molecular weight was within 0.5 Daltons of the calculated monoisotopic molecular weight. Quantification of the mass chromatogram was done using Analyst 1.4.1 software. Utilizing the synthetic methods described herein along with other commonly known techniques and suitable variations thereof, the following novel short chain peptides were prepared [Table 2 (i-xix)]. This list is indicative of the various groups of short chain peptides, which can be prepared according to the present invention, and are expected to at least include obvious variations of these short chain peptides. However, such disclosure should not be construed as limiting the scope of the invention in any way. In Table 2 (i-xix), novel short chain peptides of present invention are listed along with their corresponding Seq. ID. No.

TABLE 2 (i)

List of short-chain peptides prepared

| Seq. ID. No. | Sequence of short-chain peptides |
|---|---|
| 5 | Aib-V-Aib-EIQLMHQ-Har-AK-(α-Me-Phe) |
| 6 | Aib-V-Aib-EIQL-Nle-HQ-Har-AK-(α-Me-Phe) |
| 7 | Aib-V-Aib-EIQLMHQ-Har-(αMe-Pro)-K-(α-Me-Phe) |
| 8 | Aib-V-Aib-EIQL-Nle-HQ-Har-(αMe-Pro)-K-(α-Me-Phe) |
| 9 | Aib-V-Aib-EIQLMHQ-Har-Aib-K-(α-Me-Phe) |
| 10 | Aib-V-Aib-EIQL-Nle-HQ-Har-Aib-K-(α-Me-Phe) |
| 11 | (AC$_3$C)-V-Aib-EIQL-Nle-HQ-Har-AK-(α-Me-Phe) |
| 12 | (AC$_3$C)-V-Aib-EIQLMHQ-Har-(αMe-Pro)-K-(α-Me-Phe) |
| 13 | (AC$_3$C)-V-Aib-EIQL-Nle-HQ-Har-(αMe-Pro)-K-(α-Me-Phe) |
| 14 | (AC$_3$C)-V-Aib-EIQLMHQ-Har-Aib-K-(α-Me-Phe) |
| 15 | (AC$_3$C)-V-Aib-EIQL-Nle-HQ-Har-Aib-K-(α-Me-Phe) |
| 16 | Aib-V-(AC$_5$C)-EIQLMHQ-Har-Aib-K-(α-Me-Phe) |
| 17 | Aib-V-(AC$_5$C)-EIQL-Nle-HQ-Har-Aib-K-(α-Me-Phe) |
| 18 | (AC$_5$C)-V-(AC$_5$C)-EIQLMHQ-Har-(αMe-Pro)-K-(α-Me-Phe) |
| 19 | (AC$_5$C)-V-(AC$_5$C)-EIQL-Nle-HQ-Har-(αMe-Pro)-K-(α-Me-Phe) |
| 20 | (AC$_5$C)-V-Aib-EIQLMHQ-Har-Aib-K-(α-Me-Phe) |
| 21 | (AC$_5$C)-V-Aib-EIQL-Nle-HQ-Har-Aib-K-(α-Me-Phe) |
| 22 | Aib-V-(AC$_6$C)-EIQLMHQ-Har-Aib-K-(α-Me-Phe) |
| 23 | Aib-V-(AC$_6$C)-EIQL-Nle-HQ-Har-Aib-K-(α-Me-Phe) |
| 24 | Aib-V-Aib-EIQ-(α-Me—2F-Phe)-Nle-HQ-Har-AK-(α-Me-Phe) |
| 25 | Aib-V-Aib-EIQ-(α-Me—2F-Phe)-Nle-HQ-Har-(αMe-Pro)-K-(α-Me-Phe) |
| 26 | Aib-V-Aib-EIQ-(α-Me—2F-Phe)-Nle-HQ-Har-Aib-K-(α-Me-Phe) |
| 27 | (AC$_3$C)-V-Aib-EIQ-(α-Me—2F-Phe)-Nle-HQ-Har-AK-(α-Me-Phe) |

TABLE 2 (i)-continued

List of short-chain peptides prepared

| Seq. ID. No. | Sequence of short-chain peptides |
|---|---|
| 28 | (AC$_3$C)-V-Aib-EIQ-(α-Me—2F-Phe)-Nle-HQ-Har-(αMe-Pro)-K-(α-Me-Phe) |
| 29 | (AC$_3$C)-V-Aib-EIQ-(α-Me—2F-Phe)-Nle-HQ-Har-Aib-K-(α-Me-Phe) |
| 30 | Aib-V-(AC$_5$C)-EIQ-(α-Me—2F-Phe)-Nle-HQ-Har-AK-(α-Me-Phe) |
| 31 | Aib-V-(AC$_5$C)-EIQ-(α-Me—2F-Phe)-Nle-HQ-Har-(αMe-Pro)-K-(α-Me-Phe) |
| 32 | Aib-V-(AC$_5$C)-EIQ-(α-Me—2F-Phe)-Nle-HQ-Har-Aib-K-(α-Me-Phe) |
| 33 | (AC$_5$C)-V-(AC$_5$C)-EIQ-(α-Me—2F-Phe)-Nle-HQ-Har-AK-(α-Me-Phe) |
| 34 | (AC$_5$C)-V-(AC$_5$C)-EIQ-(α-Me—2F-Phe)-Nle-HQ-Har-(αMe-Pro)-K-(α-Me-Phe) |
| 35 | (AC$_5$C)-V-(AC$_5$C)-EIQ-(α-Me—2F-Phe)-Nle-HQ-Har-Aib-K-(α-Me-Phe) |

TABLE 2 (ii)

List of short-chain peptides prepared

| Seq. ID. No. | Sequence of short-chain peptides |
|---|---|
| 36 | Aib-V-Aib-EIQ-(α-Me-2,6-F-Phe)-Nle-HQ-Har-AK-(α-Me-Phe) |
| 37 | Aib-V-Aib-EIQ-(α-Me-2,6-F-Phe)-Nle-HQ-Har-(αMe-Pro)-K-(α-Me-Phe) |
| 38 | Aib-V-Aib-EIQ-(α-Me-2,6-F-Phe)-Nle-HQ-Har-Aib-K-(α-Me-Phe) |
| 39 | (AC$_3$C)-V-Aib-EIQ-(α-Me-2,6-F-Phe)-Nle-HQ-Har-AK-(α-Me-Phe) |
| 40 | (AC$_3$C)-V-Aib-EIQ-(α-Me-2,6-F-Phe)-Nle-HQ-Har-(αMe-Pro)-K-(α-Me-Phe) |
| 41 | (AC$_3$C)-V-Aib-EIQ-(α-Me-2,6-F-Phe)-Nle-HQ-Har-Aib-K-(α-Me-Phe) |
| 42 | Aib-V-(AC$_5$C)-EIQ-(α-Me-2,6-F-Phe)-Nle-HQ-Har-AK-(α-Me-Phe) |
| 43 | Aib-V-(AC$_5$C)-EIQ-(α-Me-2,6-F-Phe)-Nle-HQ-Har-(αMe-Pro)-K-(α-Me-Phe) |
| 44 | Aib-V-(AC$_5$C)-EIQ-(α-Me-2,6-F-Phe)-Nle-HQ-Har-Aib-K-(α-Me-Phe) |
| 45 | (AC$_5$C)-V-(AC$_5$C)-EIQ-(α-Me-2,6-F-Phe)-Nle-HQ-Har-AK-(α-Me-Phe) |
| 46 | (AC$_5$C)-V-(AC$_5$C)-EIQ-(α-Me-2,6-F-Phe)-Nle-HQ-Har-(αMe-Pro)-K-(α-Me-Phe) |
| 47 | (AC$_5$C)-V-(AC$_5$C)-EIQ-(α-Me-2,6-F-Phe)-Nle-HQ-Har-Aib-K-(α-Me-Phe) |

TABLE 2 (ii)-continued
List of short-chain peptides prepared

| Seq. ID. No. | Sequence of short-chain peptides |
|---|---|
| 48 | (AC$_5$C)-V-(AC$_5$C)-EIQ-(α-Me-2,6-F-Phe)-Nle-H-(Abu(CN))-Har-AK-(α-Me-Phe) |
| 49 | (AC$_5$C)-V-Aib-EIQ-(α-Me-2,6-F-Phe)-Nle-HQ-Har-AK-(α-Me-Phe) |
| 50 | (AC$_5$C)-V-Aib-EIQ-(α-Me-2,6-F-Phe)-Nle-HQ-Har-(αMe-Pro)-K-(α-Me-Phe) |
| 51 | (AC$_5$C)-V-Aib-EIQ-(α-Me-2,6-F-Phe)-Nle-HQ-Har-Aib-K-(α-Me-Phe) |
| 52 | (AC$_5$C)-V-(AC$_5$C)-EIQ-(α-Me-2,6-F-Phe)-M-HQ-Har-AK-(α-Me-Phe) |
| 53 | (AC$_5$C)-V-(AC$_5$C)-EIQ-(α-Me-2,6-F-Phe)-M-HQ-Har-(αMe-Pro)-K-(α-Me-Phe) |
| 54 | (AC$_5$C)-V-(AC$_5$C)-EIQ-(α-Me-2,6-F-Phe)-M-HQ-Har-Aib-K-(α-Me-Phe) |

TABLE 2 (iii)
List of short-chain peptides prepared

| Seq. ID. No. | Sequence of short-chain peptides |
|---|---|
| 55 | Aib-V-Aib-EIQ-(α-Me—2F-Phe)-Nle-HQ-Har-AK-(α-Me—2F-Phe) |
| 56 | Aib-V-Aib-EIQ-(α-Me—2F-Phe)-Nle-HQ-Har-(αMe-Pro)-K-(α-Me—2F-Phe) |
| 57 | Aib-V-Aib-EIQ-(α-Me—2F-Phe)-Nle-HQ-Har-Aib-K-(α-Me—2F-Phe) |
| 58 | (AC$_3$C)-V-Aib-EIQ-(α-Me—2F-Phe)-Nle-HQ-Har-AK-(α-Me—2F-Phe) |
| 59 | (AC$_3$C)-V-Aib-EIQ-(α-Me—2F-Phe)-Nle-HQ-Har-(αMe-Pro)-K-(α-Me—2F-Phe) |
| 60 | (AC$_3$C)-V-Aib-EIQ-(α-Me—2F-Phe)-Nle-HQ-Har-Aib-K-(α-Me—2F-Phe) |
| 61 | Aib-V-(AC$_5$C)-EIQ-(α-Me—2F-Phe)-Nle-HQ-Har-AK-(α-Me—2F-Phe) |
| 62 | Aib-V-(AC$_5$C)-EIQ-(α-Me—2F-Phe)-Nle-HQ-Har-(αMe-Pro)-K-(α-Me—2F-Phe) |
| 63 | Aib-V-(AC$_5$C)-EIQ-(α-Me—2F-Phe)-Nle-HQ-Har-Aib-K-(α-Me—2F-Phe) |
| 64 | (AC$_5$C)-V-(AC$_5$C)-EIQ-(α-Me—2F-Phe)-Nle-HQ-Har-AK-(α-Me—2F-Phe) |
| 65 | (AC$_5$C)-V-(AC$_5$C)-EIQ-(α-Me—2F-Phe)-Nle-HQ-Har-(αMe-Pro)-K-(α-Me—2F-Phe) |
| 66 | (AC$_5$C)-V-(AC$_5$C)-EIQ-(α-Me—2F-Phe)-Nle-HQ-Har-Aib-K-(α-Me—2F-Phe) |
| 67 | (AC$_5$C)-V-Aib-EIQ-(α-Me—2F-Phe)-Nle-HQ-Har-AK-(α-Me—2F-Phe) |

TABLE 2 (iii)-continued
List of short-chain peptides prepared

| Seq. ID. No. | Sequence of short-chain peptides |
|---|---|
| 68 | (AC$_5$C)-V-Aib-EIQ-(α-Me—2F-Phe)-Nle-HQ-Har-(αMe-Pro)-K-(α-Me—2F-Phe) |
| 69 | (AC$_5$C)-V-Aib-EIQ-(α-Me—2F-Phe)-Nle-HQ-Har-Aib-K-(α-Me—2F-Phe) |
| 70 | Aib-V-Aib-EIQ-(α-Me-2,6-F-Phe)-Nle-HQ-Har-A-K(Biotin)-(α-Me—2F-Phe) |
| 71 | Aib-V-Aib-EIQ-(α-Me-2,6-F-Phe)-Nle-HQ-Har-AK-(α-Me—2F-Phe) |
| 72 | Aib-V-Aib-EIQ-(α-Me-2,6-F-Phe)-Nle-HQ-Har-(αMe-Pro)-K-(α-Me—2F-Phe) |
| 73 | Aib-V-Aib-EIQ-(α-Me-2,6-F-Phe)-Nle-HQ-Har-Aib-K-(α-Me—2F-Phe) |
| 74 | (AC$_3$C)-V-Aib-EIQ-(α-Me-2,6-F-Phe)-Nle-HQ-Har-AK-(α-Me—2F-Phe) |
| 75 | (AC$_3$C)-V-Aib-EIQ-(α-Me-2,6-F-Phe)-Nle-HQ-Har-(αMe-Pro)-K-(α-Me—2F-Phe) |
| 76 | (AC$_3$C)-V-Aib-EIQ-(α-Me-2,6-F-Phe)-Nle-HQ-Har-Aib-K-(α-Me—2F-Phe) |
| 77 | Aib-V-(AC$_5$C)-EIQ-(α-Me-2,6-F-Phe)-Nle-HQ-Har-AK-(α-Me—2F-Phe) |
| 78 | Aib-V-(AC$_5$C)-EIQ-(α-Me-2,6-F-Phe)-Nle-HQ-Har-(αMe-Pro)-K-(α-Me—2F-Phe) |
| 79 | Aib-V-(AC$_5$C)-EIQ-(α-Me-2,6-F-Phe)-Nle-HQ-Har-Aib-K-(α-Me—2F-Phe) |
| 80 | (AC$_5$C)-V-(AC$_5$C)-EIQ-(α-Me-2,6-F-Phe)-Nle-HQ-Har-AK-(α-Me—2F-Phe) |
| 81 | (AC$_5$C)-V-(AC$_5$C)-EIQ-(α-Me-2,6-F-Phe)-Nle-HQ-Har-(αMe-Pro)-K-(α-Me—2F-Phe) |
| 82 | (AC$_5$C)-V-(AC$_5$C)-EIQ-(α-Me-2,6-F-Phe)-Nle-HQ-Har-Aib-K-(α-Me—2F-Phe) |
| 83 | (AC$_5$C)-V-Aib-EIQ-(α-Me-2,6-F-Phe)-Nle-HQ-Har-AK-(α-Me—2F-Phe) |
| 84 | (AC$_5$C)-V-Aib-EIQ-(α-Me-2,6-F-Phe)-Nle-HQ-Har-(αMe-Pro)-K-(α-Me—2F-Phe) |
| 85 | (AC$_5$C)-V-Aib-EIQ-(α-Me-2,6-F-Phe)-Nle-HQ-Har-Aib-K-(α-Me—2F-Phe) |
| 86 | (AC$_5$C)-V-Aib-EIQ-(α-Me-2,6-F-Phe)-Nle-H-(Abu(CN))-Har-AK-(α-Me—2F-Phe) |
| 87 | Aib-V-(AC$_6$C)-EIQ-(α-Me-2,6-F-Phe)-Nle-HQ-Har-AK-(α-Me—2F-Phe) |

TABLE 2 (iii)-continued

List of short-chain peptides prepared

| Seq. ID. No. | Sequence of short-chain peptides |
|---|---|
| 88 | Aib-V-(AC$_6$C)-EIQ-(α-Me-2,6-F-Phe)-Nle-HQ-Har-(αMe-Pro)-K-(α-Me-2F-Phe) |
| 89 | Aib-V-(AC$_6$C)-EIQ-(α-Me-2,6-F-Phe)-Nle-HQ-Har-Aib-K-(α-Me—2F-Phe) |

TABLE 2 (iv)

List of short-chain peptides prepared

| Seq. ID. No. | Sequence of short-chain peptides |
|---|---|
| 90 | Aib-V-Aib-EIQ-(α-Me—2F-Phe)-Nle-HQ-Har-AK-(α-Me-2,6-F-Phe) |
| 91 | Aib-V-Aib-EIQ-(α-Me—2F-Phe)-Nle-HQ-Har-(αMe-Pro)-K-(α-Me-2,6-F-Phe) |
| 92 | Aib-V-Aib-EIQ-(α-Me—2F-Phe)-Nle-HQ-Har-Aib-K-(α-Me-2,6-F-Phe) |
| 93 | (AC$_3$C)-V-Aib-EIQ-(α-Me—2F-Phe)-Nle-HQ-Har-AK-(α-Me-2,6-F-Phe) |
| 94 | (AC$_3$C)-V-Aib-EIQ-(α-Me—2F-Phe)-Nle-HQ-Har-(αMe-Pro)-K-(α-Me-2,6-F-Phe) |
| 95 | (AC$_3$C)-V-Aib-EIQ-(α-Me—2F-Phe)-Nle-HQ-Har-Aib-K-(α-Me-2,6-F-Phe) |
| 96 | Aib-V-(AC$_5$C)-EIQ-(α-Me—2F-Phe)-Nle-HQ-Har-AK-(α-Me-2,6-F-Phe) |
| 97 | Aib-V-(AC$_5$C)-EIQ-(α-Me—2F-Phe)-Nle-HQ-Har-(αMe-Pro)-K-(α-Me-2,6-F-Phe) |
| 98 | Aib-V-(AC$_5$C)-EIQ-(α-Me—2F-Phe)-Nle-HQ-Har-Aib-K-(α-Me-2,6-F-Phe) |
| 99 | (AC$_5$C)-V-(AC$_5$C)-EIQ-(α-Me—2F-Phe)-Nle-HQ-Har-AK-(α-Me-2,6-F-Phe) |
| 100 | (AC$_5$C)-V-(AC$_5$C)-EIQ-(α-Me—2F-Phe)-Nle-HQ-Har-(αMe-Pro)-K-(α-Me-2,6-F-Phe) |
| 101 | (AC$_5$C)-V-(AC$_5$C)-EIQ-(α-Me—2F-Phe)-Nle-HQ-Har-Aib-K-(α-Me-2,6-F-Phe) |
| 102 | (AC$_5$C)-V-Aib-EIQ-(α-Me—2F-Phe)-Nle-HQ-Har-AK-(α-Me-2,6-F-Phe) |
| 103 | (AC$_5$C)-V-Aib-EIQ-(α-Me—2F-Phe)-Nle-HQ-Har-(αMe-Pro)-K-(α-Me-2,6-F-Phe) |
| 104 | (AC$_5$C)-V-Aib-EIQ-(α-Me—2F-Phe)-Nle-HQ-Har-Aib-K-(α-Me-2,6-F-Phe) |
| 105 | Aib-V-Aib-EIQ-(α-Me-2,6-F-Phe)-Nle-HQ-Har-A-K(Biotin)-(α-Me-2,6-F-Phe) |
| 106 | Aib-V-Aib-EIQ-(α-Me-2,6-F-Phe)-Nle-HQ-Har-AK-(α-Me-2,6-F-Phe) |
| 107 | Aib-V-Aib-EIQ-(α-Me-2,6-F-Phe)-Nle-HQ-Har-(αMe-Pro)-K-(α-Me-2,6-F-Phe) |
| 108 | Aib-V-Aib-EIQ-(α-Me-2,6-F-Phe)-Nle-HQ-Har-Aib-K-(α-Me-2,6-F-Phe) |
| 109 | (AC$_3$C)-V-Aib-EIQ-(α-Me-2,6-F-Phe)-Nle-HQ-Har-AK-(α-Me-2,6-F-Phe) |
| 110 | (AC$_3$C)-V-Aib-EIQ-(α-Me-2,6-F-Phe)-Nle-HQ-Har-(αMe-Pro)-K-(α-Me-2,6-F-Phe) |
| 111 | (AC$_3$C)-V-Aib-EIQ-(α-Me-2,6-F-Phe)-Nle-HQ-Har-Aib-K-(α-Me-2,6-F-Phe) |
| 112 | Aib-V-(AC$_5$C)-EIQ-(α-Me-2,6-F-Phe)-Nle-HQ-Har-AK-(α-Me-2,6-F-Phe) |
| 113 | Aib-V-(AC$_5$C)-EIQ-(α-Me-2,6-F-Phe)-Nle-HQ-Har-(αMe-Pro)-K-(α-Me-2,6-F-Phe) |
| 114 | Aib-V-(AC$_5$C)-EIQ-(α-Me-2,6-F-Phe)-Nle-HQ-Har-Aib-K-(α-Me-2,6-F-Phe) |
| 115 | (AC$_5$C)-V-(AC$_5$C)-EIQ-(α-Me-2,6-F-Phe)-Nle-HQ-Har-AK-(α-Me-2,6-F-Phe) |

TABLE 2 (iv)-continued

List of short-chain peptides prepared

| Seq. ID. No. | Sequence of short-chain peptides |
|---|---|
| 116 | ($AC_5C$)-V-($AC_5C$)-EIQ-(α-Me-2,6-F-Phe)-Nle-HQ-Har-(αMe-Pro)-K-(α-Me-2,6-F-Phe) |
| 117 | ($AC_5C$)-V-($AC_5C$)-EIQ-(α-Me-2,6-F-Phe)-Nle-HQ-Har-Aib-K-(α-Me-2,6-F-Phe) |
| 118 | ($AC_5C$)-V-Aib-EIQ-(α-Me-2,6-F-Phe)-Nle-HQ-Har-AK-(α-Me-2,6-F-Phe) |
| 119 | ($AC_5C$)-V-Aib-EIQ-(α-Me-2,6-F-Phe)-Nle-HQ-Har-(αMe-Pro)-K-(α-Me-2,6-F-Phe) |
| 120 | ($AC_5C$)-V-Aib-EIQ-(α-Me-2,6-F-Phe)-Nle-HQ-Har-Aib-K-(α-Me-2,6-F-Phe) |

TABLE 2 (v)

List of short-chain peptides prepared

| Seq. ID. No. | Sequence of short-chain peptides |
|---|---|
| 121 | Aib-V-Aib-EIQ-(α-Me—2F-Phe)-Nle-HQ-Har-A-Cit-(α-Me—2F-Phe) |
| 122 | Aib-V-Aib-EIQ-(α-Me—2F-Phe)-Nle-HQ-Har-Aib-Cit-(α-Me—2F-Phe) |
| 123 | ($AC_3C$)-V-Aib-EIQ-(α-Me—2F-Phe)-Nle-HQ-Har-A-Cit-(α-Me—2F-Phe) |
| 124 | ($AC_3C$)-V-Aib-EIQ-(α-Me—2F-Phe)-Nle-HQ-Har-Aib-Cit-(α-Me—2F-Phe) |
| 125 | Aib-V-($AC_5C$)-EIQ-(α-Me—2F-Phe)-Nle-HQ-Har-A-Cit-(α-Me—2F-Phe) |
| 126 | Aib-V-($AC_5C$)-EIQ-(α-Me—2F-Phe)-Nle-HQ-Har-Aib-Cit-(α-Me—2F-Phe) |
| 127 | ($AC_5C$)-V-($AC_5C$)-EIQ-(α-Me—2F-Phe)-Nle-HQ-Har-A-Cit-(α-Me—2F-Phe) |
| 128 | ($AC_5C$)-V-($AC_5C$)-EIQ-(α-Me—2F-Phe)-Nle-HQ-Har-Aib-Cit-(α-Me—2F-Phe) |
| 129 | ($AC_5C$)-V-Aib-EIQ-(α-Me—2F-Phe)-Nle-HQ-Har-A-Cit-(α-Me—2F-Phe) |
| 130 | ($AC_5C$)-V-Aib-EIQ-(α-Me—2F-Phe)-Nle-HQ-Har-Aib-Cit-(α-Me—2F-Phe) |
| 131 | Aib-V-Aib-EIQ-(α-Me-2,6-F-Phe)-Nle-HQ-Har-A-Cit-(α-Me—2F-Phe) |
| 132 | Aib-V-Aib-EIQ-(α-Me-2,6-F-Phe)-Nle-HQ-Har-Aib-Cit-(α-Me—2F-Phe) |
| 133 | ($AC_3C$)-V-Aib-EIQ-(α-Me-2,6-F-Phe)-Nle-HQ-Har-A-Cit-(α-Me—2F-Phe) |
| 134 | ($AC_3C$)-V-Aib-EIQ-(α-Me-2,6-F-Phe)-Nle-HQ-Har-Aib-Cit-(α-Me—2F-Phe) |
| 135 | Aib-V-($AC_5C$)-EIQ-(α-Me-2,6-F-Phe)-Nle-HQ-Har-A-Cit-(α-Me—2F-Phe) |
| 136 | Aib-V-($AC_5C$)-EIQ-(α-Me-2,6-F-Phe)-Nle-HQ-Har-Aib-Cit-(α-Me—2F-Phe) |
| 137 | ($AC_5C$)-V-($AC_5C$)-EIQ-(α-Me-2,6-F-Phe)-Nle-HQ-Har-A-Cit-(α-Me—2F-Phe) |
| 138 | ($AC_5C$)-V-($AC_5C$)-EIQ-(α-Me-2,6-F-Phe)-Nle-HQ-Har-Aib-Cit-(α-Me—2F-Phe) |
| 139 | ($AC_5C$)-V-Aib-EIQ-(α-Me-2,6-F-Phe)-Nle-HQ-Har-A-Cit-(α-Me—2F-Phe) |
| 140 | ($AC_5C$)-V-Aib-EIQ-(α-Me-2,6-F-Phe)-Nle-HQ-Har-Aib-Cit-(α-Me—2F-Phe) |
| 141 | Aib-V-Aib-EIQ-(α-Me—2F-Phe)-Nle-HQ-Har-A-Cit-(α-Me-2,6-F-Phe) |
| 142 | Aib-V-Aib-EIQ-(α-Me—2F-Phe)-Nle-HQ-Har-Aib-Cit-(α-Me-2,6-F-Phe) |
| 143 | ($AC_3C$)-V-Aib-EIQ-(α-Me—2F-Phe)-Nle-HQ-Har-A-Cit-(α-Me-2,6-F-Phe) |
| 144 | ($AC_3C$)-V-Aib-EIQ-(α-Me—2F-Phe)-Nle-HQ-Har-Aib-Cit-(α-Me-2,6-F-Phe) |
| 145 | Aib-V-($AC_5C$)-EIQ-(α-Me—2F-Phe)-Nle-HQ-Har-A-Cit-(α-Me-2,6-F-Phe) |
| 146 | Aib-V-($AC_5C$)-EIQ-(α-Me—2F-Phe)-Nle-HQ-Har-Aib-Cit-(α-Me-2,6-F-Phe) |

TABLE 2 (v)-continued

List of short-chain peptides prepared

| Seq. ID. No. | Sequence of short-chain peptides |
|---|---|
| 147 | (AC₅C)-V-(AC₅C)-EIQ-(α-Me—2F-Phe)-Nle-HQ-Har-A-Cit-(α-Me-2,6-F-Phe) |
| 148 | (AC₅C)-V-(AC₅C)-EIQ-(α-Me—2F-Phe)-Nle-HQ-Har-Aib-Cit-(α-Me-2,6-F-Phe) |
| 149 | (AC₅C)-V-Aib-EIQ-(α-Me—2F-Phe)-Nle-HQ-Har-A-Cit-(α-Me-2,6-F-Phe) |
| 150 | (AC₅C)-V-Aib-EIQ-(α-Me—2F-Phe)-Nle-HQ-Har-Aib-Cit-(α-Me-2,6-F-Phe) |
| 151 | Aib-V-Aib-EIQ-(α-Me-2,6-F-Phe)-Nle-HQ-Har-A-Cit-(α-Me-2,6-F-Phe) |
| 152 | Aib-V-Aib-EIQ-(α-Me-2,6-F-Phe)-Nle-HQ-Har-Aib-Cit-(α-Me-2,6-F-Phe) |
| 153 | (AC₃C)-V-Aib-EIQ-(α-Me-2,6-F-Phe)-Nle-HQ-Har-A-Cit-(α-Me-2,6-F-Phe) |
| 154 | (AC₃C)-V-Aib-EIQ-(α-Me-2,6-F-Phe)-Nle-HQ-Har-Aib-Cit-(α-Me-2,6-F-Phe) |
| 155 | Aib-V-(AC₅C)-EIQ-(α-Me-2,6-F-Phe)-Nle-HQ-Har-A-Cit-(α-Me-2,6-F-Phe) |
| 156 | Aib-V-(AC₅C)-EIQ-(α-Me-2,6-F-Phe)-Nle-HQ-Har-Aib-Cit-(α-Me-2,6-F-Phe) |
| 157 | (AC₅C)-V-(AC₅C)-EIQ-(α-Me-2,6-F-Phe)-Nle-HQ-Har-A-Cit-(α-Me-2,6-F-Phe) |
| 158 | (AC₅C)-V-(AC₅C)-EIQ-(α-Me-2,6-F-Phe)-Nle-HQ-Har-Aib-Cit-(α-Me-2,6-F-Phe) |
| 159 | (AC₅C)-V-Aib-EIQ-(α-Me-2,6-F-Phe)-Nle-HQ-Har-A-Cit-(α-Me-2,6-F-Phe) |
| 160 | (AC₅C)-V-Aib-EIQ-(α-Me-2,6-F-Phe)-Nle-HQ-Har-Aib-Cit-(α-Me-2,6-F-Phe) |

TABLE 2 (vi)

List of short-chain peptides prepared

| Seq. ID. No. | Sequence of short-chain peptides |
|---|---|
| 161 | Aib-V-Aib-EIQ-(α-Me—2F-Phe)-Nle-HQ-Har-A-Aib-(α-Me—2F-Phe) |
| 162 | Aib-V-Aib-EIQ-(α-Me—2F-Phe)-Nle-HQ-Har-Aib-Aib-(α-Me—2F-Phe) |
| 163 | (AC₃C)-V-Aib-EIQ-(α-Me—2F-Phe)-Nle-HQ-Har-A-Aib-(α-Me—2F-Phe) |
| 164 | (AC₃C)-V-Aib-EIQ-(α-Me—2F-Phe)-Nle-HQ-Har-Aib-Aib-(α-Me—2F-Phe) |
| 165 | Aib-V-(AC₅C)-EIQ-(α-Me—2F-Phe)-Nle-HQ-Har-A-Aib-(α-Me—2F-Phe) |
| 166 | Aib-V-(AC₅C)-EIQ-(α-Me—2F-Phe)-Nle-HQ-Har-Aib-Aib-(α-Me—2F-Phe) |
| 167 | (AC₅C)-V-(AC₅C)-EIQ-(α-Me—2F-Phe)-Nle-HQ-Har-A-Aib-(α-Me—2F-Phe) |
| 168 | (AC₅C)-V-(AC₅C)-EIQ-(α-Me—2F-Phe)-Nle-HQ-Har-Aib-Aib-(α-Me—2F-Phe) |
| 169 | (AC₅C)-V-Aib-EIQ-(α-Me—2F-Phe)-Nle-HQ-Har-A-Aib-(α-Me—2F-Phe) |
| 170 | (AC₅C)-V-Aib-EIQ-(α-Me—2F-Phe)-Nle-HQ-Har-Aib-Aib-(α-Me—2F-Phe) |
| 171 | Aib-V-Aib-EIQ-(α-Me-2,6-F-Phe)-Nle-HQ-Har-A-Aib-(α-Me—2F-Phe) |
| 172 | Aib-V-Aib-EIQ-(α-Me-2,6-F-Phe)-Nle-HQ-Har-Aib-Aib-(α-Me—2F-Phe) |
| 173 | (AC₃C)-V-Aib-EIQ-(α-Me-2,6-F-Phe)-Nle-HQ-Har-A-Aib-(α-Me—2F-Phe) |
| 174 | (AC₃C)-V-Aib-EIQ-(α-Me-2,6-F-Phe)-Nle-HQ-Har-Aib-Aib-(α-Me—2F-Phe) |
| 175 | Aib-V-(AC₅C)-EIQ-(α-Me-2,6-F-Phe)-Nle-HQ-Har-A-Aib-(α-Me—2F-Phe) |
| 176 | Aib-V-(AC₅C)-EIQ-(α-Me-2,6-F-Phe)-Nle-HQ-Har-Aib-Aib-(α-Me—2F-Phe) |
| 177 | (AC₅C)-V-(AC₅C)-EIQ-(α-Me-2,6-F-Phe)-Nle-HQ-Har-A-Aib-(α-Me—2F-Phe) |

TABLE 2 (vi)-continued

List of short-chain peptides prepared

| Seq. ID. No. | Sequence of short-chain peptides |
|---|---|
| 178 | (AC$_5$C)-V-(AC$_5$C)-EIQ-(α-Me-2,6-F-Phe)-Nle-HQ-Har-Aib-Aib-(α-Me—2F-Phe) |
| 179 | (AC$_5$C)-V-Aib-EIQ-(α-Me-2,6-F-Phe)-Nle-HQ-Har-A-Aib-(α-Me—2F-Phe) |
| 180 | (AC$_5$C)-V-Aib-EIQ-(α-Me-2,6-F-Phe)-Nle-HQ-Har-Aib-Aib-(α-Me—2F-Phe) |
| 181 | Aib-V-Aib-EIQ-(α-Me—2F-Phe)-Nle-HQ-Har-A-Aib-(α-Me-2,6-F-Phe) |
| 182 | Aib-V-Aib-EIQ-(α-Me—2F-Phe)-Nle-HQ-Har-Aib-Aib-(α-Me-2,6-F-Phe) |
| 183 | (AC$_3$C)-V-Aib-EIQ-(α-Me—2F-Phe)-Nle-HQ-Har-A-Aib-(α-Me-2,6-F-Phe) |
| 184 | (AC$_3$C)-V-Aib-EIQ-(α-Me—2F-Phe)-Nle-HQ-Har-Aib-Aib-(α-Me-2,6-F-Phe) |
| 185 | Aib-V-(AC$_5$C)-EIQ-(α-Me—2F-Phe)-Nle-HQ-Har-A-Aib-(α-Me-2,6-F-Phe) |
| 186 | Aib-V-(AC$_5$C)-EIQ-(α-Me—2F-Phe)-Nle-HQ-Har-Aib-Aib-(α-Me-2,6-F-Phe) |
| 187 | (AC$_5$C)-V-(AC$_5$C)-EIQ-(α-Me—2F-Phe)-Nle-HQ-Har-A-Aib-(α-Me-2,6-F-Phe) |
| 188 | (AC$_5$C)-V-(AC$_5$C)-EIQ-(α-Me—2F-Phe)-Nle-HQ-Har-Aib-Aib-(α-Me-2,6-F-Phe) |
| 189 | (AC$_5$C)-V-Aib-EIQ-(α-Me—2F-Phe)-Nle-HQ-Har-A-Aib-(α-Me-2,6-F-Phe) |
| 190 | (AC$_5$C)-V-Aib-EIQ-(α-Me—2F-Phe)-Nle-HQ-Har-Aib-Aib-(α-Me-2,6-F-Phe) |
| 191 | Aib-V-Aib-EIQ-(α-Me-2,6-F-Phe)-Nle-HQ-Har-A-Aib-(α-Me-2,6-F-Phe) |
| 192 | Aib-V-Aib-EIQ-(α-Me-2,6-F-Phe)-Nle-HQ-Har-Aib-Aib-(α-Me-2,6-F-Phe) |
| 193 | (AC$_3$C)-V-Aib-EIQ-(α-Me-2,6-F-Phe)-Nle-HQ-Har-A-Aib-(α-Me-2,6-F-Phe) |
| 194 | (AC$_3$C)-V-Aib-EIQ-(α-Me-2,6-F-Phe)-Nle-HQ-Har-Aib-Aib-(α-Me-2,6-F-Phe) |
| 195 | Aib-V-(AC$_5$C)-EIQ-(α-Me-2,6-F-Phe)-Nle-HQ-Har-A-Aib-(α-Me-2,6-F-Phe) |
| 196 | Aib-V-(AC$_5$C)-EIQ-(α-Me-2,6-F-Phe)-Nle-HQ-Har-Aib-Aib-(α-Me-2,6-F-Phe) |
| 197 | (AC$_5$C)-V-(AC$_5$C)-EIQ-(α-Me-2,6-F-Phe)-Nle-HQ-Har-A-Aib-(α-Me-2,6-F-Phe) |
| 198 | (AC$_5$C)-V-(AC$_5$C)-EIQ-(α-Me-2,6-F-Phe)-Nle-HQ-Har-Aib-Aib-(α-Me-2,6-F-Phe) |
| 199 | (AC$_5$C)-V-Aib-EIQ-(α-Me-2,6-F-Phe)-Nle-HQ-Har-A-Aib-(α-Me-2,6-F-Phe) |
| 200 | (AC$_5$C)-V-Aib-EIQ-(α-Me-2,6-F-Phe)-Nle-HQ-Har-Aib-Aib-(α-Me-2,6-F-Phe) |

TABLE 2 (vii)

List of short-chain peptides prepared

| Seq. ID. No. | Sequence of short-chain peptides |
|---|---|
| 201 | Aib-V-Aib-EIQ-(α-Me—2F-Phe)-Nle-HQ-Har-A-(α-Me-2,6-F-Phe)-(α-Me—2F-Phe) |
| 202 | Aib-V-Aib-EIQ-(α-Me—2F-Phe)-Nle-HQ-Har-Aib-(α-Me-2,6-F-Phe)-(α-Me-2F-Phe) |
| 203 | (AC$_3$C)-V-Aib-EIQ-(α-Me—2F-Phe)-Nle-HQ-Har-A-(α-Me-2,6-F-Phe)-(α-Me-2F-Phe) |
| 204 | (AC$_3$C)-V-Aib-EIQ-(α-Me—2F-Phe)-Nle-HQ-Har-Aib-(α-Me-2,6-F-Phe)-(α-Me—2F-Phe) |

TABLE 2 (vii)-continued

List of short-chain peptides prepared

| Seq. ID. No. | Sequence of short-chain peptides |
|---|---|
| 205 | Aib-V-(AC$_5$C)-EIQ-(α-Me—2F-Phe)-Nle-HQ-Har-A-(α-Me-2,6-F-Phe)-(α-Me-2F-Phe) |
| 206 | Aib-V-(AC$_5$C)-EIQ-(α-Me—2F-Phe)-Nle-HQ-Har-Aib-(α-Me-2,6-F-Phe)-(α-Me—2F-Phe) |
| 207 | (AC$_5$C)-V-(AC$_5$C)-EIQ-(α-Me—2F-Phe)-Nle-HQ-Har-A-(α-Me-2,6-F-Phe)-(α-Me—2F-Phe) |
| 208 | (AC$_5$C)-V-(AC$_5$C)-EIQ-(α-Me—2F-Phe)-Nle-HQ-Har-Aib-(α-Me-2,6-F-Phe)-(α-Me—2F-Phe) |
| 209 | (AC$_5$C)-V-Aib-EIQ-(α-Me—2F-Phe)-Nle-HQ-Har-A-(α-Me-2,6-F-Phe)-(α-Me-2F-Phe) |
| 210 | (AC$_5$C)-V-Aib-EIQ-(α-Me—2F-Phe)-Nle-HQ-Har-Aib-(α-Me-2,6-F-Phe)-(α-Me—2F-Phe) |
| 211 | Aib-V-Aib-EIQ-(α-Me-2,6-F-Phe)-Nle-HQ-Har-A-(α-Me-2,6-F-Phe)-(α-Me-2F-Phe) |
| 212 | Aib-V-Aib-EIQ-(α-Me-2,6-F-Phe)-Nle-HQ-Har-Aib-(α-Me-2,6-F-Phe)-(α-Me—2F-Phe) |
| 213 | (AC$_3$C)-V-Aib-EIQ-(α-Me-2,6-F-Phe)-Nle-HQ-Har-A-(α-Me-2,6-F-Phe)-(α-Me—2F-Phe) |
| 214 | (AC$_3$C)-V-Aib-EIQ-(α-Me-2,6-F-Phe)-Nle-HQ-Har-Aib-(α-Me-2,6-F-Phe)-(α-Me—2F-Phe) |
| 215 | Aib-V-(AC$_5$C)-EIQ-(α-Me-2,6-F-Phe)-Nle-HQ-Har-A-(α-Me-2,6-F-Phe)-(α-Me—2F-Phe) |
| 216 | Aib-V-(AC$_5$C)-EIQ-(α-Me-2,6-F-Phe)-Nle-HQ-Har-Aib-(α-Me-2,6-F-Phe)-(α-Me—2F-Phe) |
| 217 | (AC$_5$C)-V-(AC$_5$C)-EIQ-(α-Me-2,6-F-Phe)-Nle-HQ-Har-A-(α-Me-2,6-F-Phe)-(α-Me—2F-Phe) |
| 218 | (AC$_5$C)-V-(AC$_5$C)-EIQ-(α-Me-2,6-F-Phe)-Nle-HQ-Har-Aib-(α-Me-2,6-F-Phe)-(α-Me—2F-Phe) |
| 219 | (AC$_5$C)-V-Aib-EIQ-(α-Me-2,6-F-Phe)-Nle-HQ-Har-A-(α-Me-2,6-F-Phe)-(α-Me—2F-Phe) |
| 220 | (AC$_5$C)-V-Aib-EIQ-(α-Me-2,6-F-Phe)-Nle-HQ-Har-Aib-(α-Me-2,6-F-Phe)-(α-Me—2F-Phe) |
| 221 | Aib-V-Aib-EIQ-(α-Me—2F-Phe)-Nle-HQ-Har-A-(α-Me-2,6-F-Phe)-(α-Me-2,6-F-Phe) |
| 222 | Aib-V-Aib-EIQ-(α-Me—2F-Phe)-Nle-HQ-Har-Aib-(α-Me-2,6-F-Phe)-(α-Me-2,6-F-Phe) |
| 223 | (AC$_3$C)-V-Aib-EIQ-(α-Me—2F-Phe)-Nle-HQ-Har-A-(α-Me-2,6-F-Phe)-(α-Me-2,6-F-Phe) |
| 224 | (AC$_3$C)-V-Aib-EIQ-(α-Me—2F-Phe)-Nle-HQ-Har-Aib-(α-Me-2,6-F-Phe)-(α-Me-2,6-F-Phe) |
| 225 | Aib-V-(AC$_5$C)-EIQ-(α-Me—2F-Phe)-Nle-HQ-Har-A-(α-Me-2,6-F-Phe)-(α-Me-2,6-F-Phe) |
| 226 | Aib-V-(AC$_5$C)-EIQ-(α-Me—2F-Phe)-Nle-HQ-Har-Aib-(α-Me-2,6-F-Phe)-(α-Me-2,6-F-Phe) |
| 227 | (AC$_5$C)-V-(AC$_5$C)-EIQ-(α-Me—2F-Phe)-Nle-HQ-Har-A-(α-Me-2,6-F-Phe)-(α-Me-2,6-F-Phe) |
| 228 | (AC$_5$C)-V-(AC$_5$C)-EIQ-(α-Me—2F-Phe)-Nle-HQ-Har-Aib-(α-Me-2,6-F-Phe)-(α-Me-2,6-F-Phe) |
| 229 | (AC$_5$C)-V-Aib-EIQ-(α-Me—2F-Phe)-Nle-HQ-Har-A-(α-Me-2,6-F-Phe)-(α-Me-2,6-F-Phe) |

TABLE 2 (vii)-continued

List of short-chain peptides prepared

| Seq. ID. No. | Sequence of short-chain peptides |
|---|---|
| 230 | (AC$_5$C)-V-Aib-EIQ-(α-Me—2F-Phe)-Nle-HQ-Har-Aib-(α-Me-2,6-F-Phe)-(α-Me-2,6-F-Phe) |
| 231 | Aib-V-Aib-EIQ-(α-Me-2,6-F-Phe)-Nle-HQ-Har-A-(α-Me-2,6-F-Phe)-(α-Me-2,6-F-Phe) |
| 232 | Aib-V-Aib-EIQ-(α-Me-2,6-F-Phe)-Nle-HQ-Har-Aib-(α-Me-2,6-F-Phe)-(α-Me-2,6-F-Phe) |
| 233 | (AC$_3$C)-V-Aib-EIQ-(α-Me-2,6-F-Phe)-Nle-HQ-Har-A-(α-Me-2,6-F-Phe)-(α-Me-2,6-F-Phe) |
| 234 | (AC$_3$C)-V-Aib-EIQ-(α-Me-2,6-F-Phe)-Nle-HQ-Har-Aib-(α-Me-2,6-F-Phe)-(α-Me-2,6-F-Phe) |
| 235 | Aib-V-(AC$_5$C)-EIQ-(α-Me-2,6-F-Phe)-Nle-HQ-Har-A-(α-Me-2,6-F-Phe)-(α-Me-2,6-F-Phe) |
| 236 | Aib-V-(AC$_5$C)-EIQ-(α-Me-2,6-F-Phe)-Nle-HQ-Har-Aib-(α-Me-2,6-F-Phe)-(α-Me-2,6-F-Phe) |
| 237 | (AC$_5$C)-V-(AC$_5$C)-EIQ-(α-Me-2,6-F-Phe)-Nle-HQ-Har-A-(α-Me-2,6-F-Phe)-(α-Me-2,6-F-Phe) |
| 238 | (AC$_5$C)-V-(AC$_5$C)-EIQ-(α-Me-2,6-F-Phe)-Nle-HQ-Har-Aib-(α-Me-2,6-F-Phe)-(α-Me-2,6-F-Phe) |
| 239 | (AC$_5$C)-V-Aib-EIQ-(α-Me-2,6-F-Phe)-Nle-HQ-Har-A-(α-Me-2,6-F-Phe)-(α-Me-2,6-F-Phe) |
| 240 | (AC$_5$C)-V-Aib-EIQ-(α-Me-2,6-F-Phe)-Nle-HQ-Har-Aib-(α-Me-2,6-F-Phe)-(α-Me-2,6-F-Phe) |

TABLE 2 (viii)

List of short-chain peptides prepared

| Seq. ID. No. | Sequence of short-chain peptides |
|---|---|
| 241 | Aib-V-Aib-EIQ-(α-Me—2F-Phe)-Nle-HQ-Har-A-Arg(NO$_2$)-(α-Me—2F-Phe) |
| 242 | Aib-V-Aib-EIQ-(α-Me—2F-Phe)-Nle-HQ-Har-Aib-Arg(NO$_2$)-(α-Me—2F-Phe) |
| 243 | (AC$_3$C)-V-Aib-EIQ-(α-Me—2F-Phe)-Nle-HQ-Har-A-Arg(NO$_2$)-(α-Me—2F-Phe) |
| 244 | (AC$_3$C)-V-Aib-EIQ-(α-Me—2F-Phe)-Nle-HQ-Har-Aib-Arg(NO$_2$)-(α-Me—2F-Phe) |
| 245 | Aib-V-(AC$_5$C)-EIQ-(α-Me—2F-Phe)-Nle-HQ-Har-A-Arg(NO$_2$)-(α-Me—2F-Phe) |
| 246 | Aib-V-(AC$_5$C)-EIQ-(α-Me—2F-Phe)-Nle-HQ-Har-Aib-Arg(NO$_2$)-(α-Me—2F-Phe) |
| 247 | (AC$_5$C)-V-(AC$_5$C)-EIQ-(α-Me—2F-Phe)-Nle-HQ-Har-A-Arg(NO$_2$)-(α-Me—2F-Phe) |
| 248 | (AC$_5$C)-V-(AC$_5$C)-EIQ-(α-Me—2F-Phe)-Nle-HQ-Har-Aib-Arg(NO$_2$)-(α-Me—2F-Phe) |
| 249 | (AC$_5$C)-V-Aib-EIQ-(α-Me—2F-Phe)-Nle-HQ-Har-A-Arg(NO$_2$)-(α-Me—2F-Phe) |
| 250 | (AC$_5$C)-V-Aib-EIQ-(α-Me—2F-Phe)-Nle-HQ-Har-Aib-Arg(NO$_2$)-(α-Me—2F-Phe) |
| 251 | Aib-V-Aib-EIQ-(α-Me-2,6-F-Phe)-Nle-HQ-Har-A-Arg(NO$_2$)-(α-Me—2F-Phe) |
| 252 | Aib-V-Aib-EIQ-(α-Me-2,6-F-Phe)-Nle-HQ-Har-Aib-Arg(NO$_2$)-(α-Me—2F-Phe) |
| 253 | (AC$_3$C)-V-Aib-EIQ-(α-Me-2,6-F-Phe)-Nle-HQ-Har-A-Arg(NO$_2$)-(α-Me—2F-Phe) |

TABLE 2 (viii)-continued

List of short-chain peptides prepared

| Seq. ID. No. | Sequence of short-chain peptides |
|---|---|
| 254 | (AC$_3$C)-V-Aib-EIQ-(α-Me-2,6-F-Phe)-Nle-HQ-Har-Aib-Arg(NO$_2$)-(α-Me—2F-Phe) |
| 255 | Aib-V-(AC$_5$C)-EIQ-(α-Me-2,6-F-Phe)-Nle-HQ-Har-A-Arg(NO$_2$)-(α-Me—2F-Phe) |
| 256 | Aib-V-(AC$_5$C)-EIQ-(α-Me-2,6-F-Phe)-Nle-HQ-Har-Aib-Arg(NO$_2$)-(α-Me—2F-Phe) |
| 257 | (AC$_5$C)-V-(AC$_5$C)-EIQ-(α-Me-2,6-F-Phe)-Nle-HQ-Har-A-Arg(NO$_2$)-(α-Me-2F-Phe) |
| 258 | (AC$_5$C)-V-(AC$_5$C)-EIQ-(α-Me-2,6-F-Phe)-Nle-HQ-Har-Aib-Arg(NO$_2$)-(α-Me-2F-Phe) |
| 259 | (AC$_5$C)-V-Aib-EIQ-(α-Me-2,6-F-Phe)-Nle-HQ-Har-A-Arg(NO$_2$)-(α-Me—2F-Phe) |
| 260 | (AC$_5$C)-V-Aib-EIQ-(α-Me-2,6-F-Phe)-Nle-HQ-Har-Aib-Arg(NO$_2$)-(α-Me—2F-Phe) |
| 261 | Aib-V-Aib-EIQ-(α-Me—2F-Phe)-Nle-HQ-Har-A-Arg(NO$_2$)-(α-Me-2,6-F-Phe) |
| 262 | Aib-V-Aib-EIQ-(α-Me—2F-Phe)-Nle-HQ-Har-Aib-Arg(NO$_2$)-(α-Me-2,6-F-Phe) |
| 263 | (AC$_3$C)-V-Aib-EIQ-(α-Me—2F-Phe)-Nle-HQ-Har-A-Arg(NO$_2$)-(α-Me-2,6-F-Phe) |
| 264 | (AC$_3$C)-V-Aib-EIQ-(α-Me—2F-Phe)-Nle-HQ-Har-Aib-Arg(NO$_2$)-(α-Me-2,6-F-Phe) |
| 265 | Aib-V-(AC$_5$C)-EIQ-(α-Me—2F-Phe)-Nle-HQ-Har-A-Arg(NO$_2$)-(α-Me-2,6-F-Phe) |
| 266 | Aib-V-(AC$_5$C)-EIQ-(α-Me—2F-Phe)-Nle-HQ-Har-Aib-Arg(NO$_2$)-(α-Me-2,6-F-Phe) |
| 267 | (AC$_5$C)-V-(AC$_5$C)-EIQ-(α-Me—2F-Phe)-Nle-HQ-Har-A-Arg(NO$_2$)-(α-Me-2,6-F-Phe) |
| 268 | (AC$_5$C)-V-(AC$_5$C)-EIQ-(α-Me—2F-Phe)-Nle-HQ-Har-Aib-Arg(NO$_2$)-(α-Me-2,6-F-Phe) |
| 269 | (AC$_5$C)-V-Aib-EIQ-(α-Me—2F-Phe)-Nle-HQ-Har-A-Arg(NO$_2$)-(α-Me-2,6-F-Phe) |
| 270 | (AC$_5$C)-V-Aib-EIQ-(α-Me—2F-Phe)-Nle-HQ-Har-Aib-Arg(NO$_2$)-(α-Me-2,6-F-Phe) |
| 271 | Aib-V-Aib-EIQ-(α-Me-2,6-F-Phe)-Nle-HQ-Har-A-Arg(NO$_2$)-(α-Me-2,6-F-Phe) |
| 272 | Aib-V-Aib-EIQ-(α-Me-2,6-F-Phe)-Nle-HQ-Har-Aib-Arg(NO$_2$)-(α-Me-2,6-F-Phe) |
| 273 | (AC$_3$C)-V-Aib-EIQ-(α-Me-2,6-F-Phe)-Nle-HQ-Har-A-Arg(NO$_2$)-(α-Me-2,6-F-Phe) |
| 274 | (AC$_3$C)-V-Aib-EIQ-(α-Me-2,6-F-Phe)-Nle-HQ-Har-Aib-Arg(NO$_2$)-(α-Me-2,6-F-Phe) |
| 275 | Aib-V-(AC$_5$C)-EIQ-(α-Me-2,6-F-Phe)-Nle-HQ-Har-A-Arg(NO$_2$)-(α-Me-2,6-F-Phe) |
| 276 | Aib-V-(AC$_5$C)-EIQ-(α-Me-2,6-F-Phe)-Nle-HQ-Har-Aib-Arg(NO$_2$)-(α-Me-2,6-F-Phe) |
| 277 | (AC$_5$C)-V-(AC$_5$C)-EIQ-(α-Me-2,6-F-Phe)-Nle-HQ-Har-A-Arg(NO$_2$)-(α-Me-2,6-F-Phe) |
| 278 | (AC$_5$C)-V-(AC$_5$C)-EIQ-(α-Me-2,6-F-Phe)-Nle-HQ-Har-Aib-Arg(NO$_2$)-(α-Me-2,6-F-Phe) |

TABLE 2 (viii)-continued

List of short-chain peptides prepared

| Seq. ID. No. | Sequence of short-chain peptides |
|---|---|
| 279 | (AC₅C)-V-Aib-EIQ-(α-Me-2,6-F-Phe)-Nle-HQ-Har-A-Arg(NO₂)-(α-Me-2,6-F-Phe) |
| 280 | (AC₅C)-V-Aib-EIQ-(α-Me-2,6-F-Phe)-Nle-HQ-Har-Aib-Arg(NO₂)-(α-Me-2,6-F-Phe) |

TABLE 2 (ix)

List of short-chain peptides prepared

| Seq. ID. No. | Sequence of short-chain peptides |
|---|---|
| 281 | Aib-V-Aib-EIQ-(α-Me—2F-Phe)-Nle-HQ-Orn-A-Cit-(α-Me—2F-Phe) |
| 282 | Aib-V-Aib-EIQ-(α-Me—2F-Phe)-Nle-HQ-Orn-Aib-Cit-(α-Me—2F-Phe) |
| 283 | (AC₅C)-V-Aib-EIQ-(α-Me—2F-Phe)-Nle-HQ-Orn-A-Cit-(α-Me—2F-Phe) |
| 284 | (AC₅C)-V-Aib-EIQ-(α-Me—2F-Phe)-Nle-HQ-Orn-Aib-Cit-(α-Me—2F-Phe) |
| 285 | Aib-V-Aib-EIQ-(α-Me-2,6-F-Phe)-Nle-HQ-Orn-A-Cit-(α-Me—2F-Phe) |
| 286 | Aib-V-Aib-EIQ-(α-Me-2,6-F-Phe)-Nle-HQ-Orn-Aib-Cit-(α-Me—2F-Phe) |
| 287 | (AC₅C)-V-Aib-EIQ-(α-Me-2,6-F-Phe)-Nle-HQ-Orn-A-Cit-(α-Me—2F-Phe) |
| 288 | (AC₅C)-V-Aib-EIQ-(α-Me-2,6-F-Phe)-Nle-HQ-Orn-Aib-Cit-(α-Me—2F-Phe) |
| 289 | Aib-V-Aib-EIQ-(α-Me—2F-Phe)-Nle-HQ-Orn-A-Cit-(α-Me-2,6-F-Phe) |
| 290 | Aib-V-Aib-EIQ-(α-Me—2F-Phe)-Nle-HQ-Orn-Aib-Cit-(α-Me-2,6-F-Phe) |
| 291 | (AC₅C)-V-Aib-EIQ-(α-Me—2F-Phe)-Nle-HQ-Orn-A-Cit-(α-Me-2,6-F-Phe) |
| 292 | (AC₅C)-V-Aib-EIQ-(α-Me—2F-Phe)-Nle-HQ-Orn-Aib-Cit-(α-Me-2,6-F-Phe) |
| 293 | Aib-V-Aib-EIQ-(α-Me-2,6-F-Phe)-Nle-HQ-Orn-A-Cit-(α-Me-2,6-F-Phe) |
| 294 | Aib-V-Aib-EIQ-(α-Me-2,6-F-Phe)-Nle-HQ-Orn-Aib-Cit-(α-Me-2,6-F-Phe) |
| 295 | (AC₅C)-V-Aib-EIQ-(α-Me-2,6-F-Phe)-Nle-HQ-Orn-A-Cit-(α-Me-2,6-F-Phe) |
| 296 | (AC₅C)-V-Aib-EIQ-(α-Me-2,6-F-Phe)-Nle-HQ-Orn-Aib-Cit-(α-Me-2,6-F-Phe) |
| 297 | Aib-V-Aib-EIQ-(α-Me—2F-Phe)-Nle-HQ-Orn-A-Aib-(α-Me—2F-Phe) |
| 298 | Aib-V-Aib-EIQ-(α-Me—2F-Phe)-Nle-HQ-Orn-Aib-Aib-(α-Me—2F-Phe) |
| 299 | (AC₅C)-V-Aib-EIQ-(α-Me—2F-Phe)-Nle-HQ-Orn-A-Aib-(α-Me—2F-Phe) |
| 300 | (AC₅C)-V-Aib-EIQ-(α-Me—2F-Phe)-Nle-HQ-Orn-Aib-Aib-(α-Me—2F-Phe) |
| 301 | Aib-V-Aib-EIQ-(α-Me-2,6-F-Phe)-Nle-HQ-Orn-A-Aib-(α-Me—2F-Phe) |
| 302 | Aib-V-Aib-EIQ-(α-Me-2,6-F-Phe)-Nle-HQ-Orn-Aib-Aib-(α-Me—2F-Phe) |
| 303 | (AC₅C)-V-Aib-EIQ-(α-Me-2,6-F-Phe)-Nle-HQ-Orn-A-Aib-(α-Me—2F-Phe) |
| 304 | (AC₅C)-V-Aib-EIQ-(α-Me-2,6-F-Phe)-Nle-HQ-Orn-Aib-Aib-(α-Me—2F-Phe) |
| 305 | Aib-V-Aib-EIQ-(α-Me—2F-Phe)-Nle-HQ-Orn-A-Aib-(α-Me-2,6-F-Phe) |
| 306 | Aib-V-Aib-EIQ-(α-Me—2F-Phe)-Nle-HQ-Orn-Aib-Aib-(α-Me-2,6-F-Phe) |
| 307 | (AC₅C)-V-Aib-EIQ-(α-Me—2F-Phe)-Nle-HQ-Orn-A-Aib-(α-Me-2,6-F-Phe) |
| 308 | (AC₅C)-V-Aib-EIQ-(α-Me—2F-Phe)-Nle-HQ-Orn-Aib-Aib-(α-Me-2,6-F-Phe) |
| 309 | Aib-V-Aib-EIQ-(α-Me-2,6-F-Phe)-Nle-HQ-Orn-A-Aib-(α-Me-2,6-F-Phe) |
| 310 | Aib-V-Aib-EIQ-(α-Me-2,6-F-Phe)-Nle-HQ-Orn-Aib-Aib-(α-Me-2,6-F-Phe) |

TABLE 2 (ix)-continued

List of short-chain peptides prepared

| Seq. ID. No. | Sequence of short-chain peptides |
|---|---|
| 311 | (AC$_5$C)-V-Aib-EIQ-(α-Me-2,6-F-Phe)-Nle-HQ-Orn-A-Aib-(α-Me-2,6-F-Phe) |
| 312 | (AC$_5$C)-V-Aib-EIQ-(α-Me-2,6-F-Phe)-Nle-HQ-Orn-Aib-Aib-(α-Me-2,6-F-Phe) |
| 313 | Aib-V-Aib-EIQ-(α-Me—2F-Phe)-Nle-HQ-Orn-A-(α-Me-2,6-F-Phe)-(α-Me—2F-Phe) |
| 314 | Aib-V-Aib-EIQ-(α-Me—2F-Phe)-Nle-HQ-Orn-Aib-(α-Me-2,6-F-Phe)-(α-Me-2F-Phe) |
| 315 | (AC$_5$C)-V-Aib-EIQ-(α-Me—2F-Phe)-Nle-HQ-Orn-A-(α-Me-2,6-F-Phe)-(α-Me-2F-Phe) |
| 316 | (AC$_5$C)-V-Aib-EIQ-(α-Me—2F-Phe)-Nle-HQ-Orn-Aib-(α-Me-2,6-F-Phe)-(α-Me—2F-Phe) |
| 317 | Aib-V-Aib-EIQ-(α-Me-2,6-F-Phe)-Nle-HQ-Orn-A-(α-Me-2,6-F-Phe)-(α-Me-2F-Phe) |
| 318 | Aib-V-Aib-EIQ-(α-Me-2,6-F-Phe)-Nle-HQ-Orn-Aib-(α-Me-2,6-F-Phe)-(α-Me—2F-Phe) |
| 319 | (AC$_5$C)-V-Aib-EIQ-(α-Me-2,6-F-Phe)-Nle-HQ-Orn-A-(α-Me-2,6-F-Phe)-(α-Me—2F-Phe) |
| 320 | (AC$_5$C)-V-Aib-EIQ-(α-Me-2,6-F-Phe)-Nle-HQ-Orn-Aib-(α-Me-2,6-F-Phe)-(α-Me—2F-Phe) |
| 321 | Aib-V-Aib-EIQ-(α-Me—2F-Phe)-Nle-HQ-Orn-A-(α-Me-2,6-F-Phe)-(α-Me-2,6-F-Phe) |
| 322 | Aib-V-Aib-EIQ-(α-Me—2F-Phe)-Nle-HQ-Orn-Aib-(α-Me-2,6-F-Phe)-(α-Me-2,6-F-Phe) |
| 323 | (AC$_5$C)-V-Aib-EIQ-(α-Me—2F-Phe)-Nle-HQ-Orn-A-(α-Me-2,6-F-Phe)-(α-Me-2,6-F-Phe) |
| 324 | (AC$_5$C)-V-Aib-EIQ-(α-Me—2F-Phe)-Nle-HQ-Orn-Aib-(α-Me-2,6-F-Phe)-(α-Me-2,6-F-Phe) |
| 325 | Aib-V-Aib-EIQ-(α-Me-2,6-F-Phe)-Nle-HQ-Orn-A-(α-Me-2,6-F-Phe)-(α-Me-2,6-F-Phe) |
| 326 | Aib-V-Aib-EIQ-(α-Me-2,6-F-Phe)-Nle-HQ-Orn-Aib-(α-Me-2,6-F-Phe)-(α-Me-2,6-F-Phe) |
| 327 | (AC$_5$C)-V-Aib-EIQ-(α-Me-2,6-F-Phe)-Nle-HQ-Orn-A-(α-Me-2,6-F-Phe)-(α-Me-2,6-F-Phe) |
| 328 | (AC$_5$C)-V-Aib-EIQ-(α-Me-2,6-F-Phe)-Nle-HQ-Orn-Aib-(α-Me-2,6-F-Phe)-(α-Me-2,6-F-Phe) |
| 329 | Aib-V-Aib-EIQ-(α-Me—2F-Phe)-Nle-HQ-Orn-A-Arg(NO$_2$)-(α-Me—2F-Phe) |
| 330 | Aib-V-Aib-EIQ-(α-Me—2F-Phe)-Nle-HQ-Orn-Aib-Arg(NO$_2$)-(α-Me—2F-Phe) |
| 331 | (AC$_5$C)-V-Aib-EIQ-(α-Me—2F-Phe)-Nle-HQ-Orn-A-Arg(NO$_2$)-(α-Me—2F-Phe) |
| 332 | (AC$_5$C)-V-Aib-EIQ-(α-Me—2F-Phe)-Nle-HQ-Orn-Aib-Arg(NO$_2$)-(α-Me—2F-Phe) |
| 333 | Aib-V-Aib-EIQ-(α-Me-2,6-F-Phe)-Nle-HQ-Orn-A-Arg(NO$_2$)-(α-Me—2F-Phe) |
| 334 | Aib-V-Aib-EIQ-(α-Me-2,6-F-Phe)-Nle-HQ-Orn-Aib-Arg(NO$_2$)-(α-Me—2F-Phe) |
| 335 | (AC$_5$C)-V-Aib-EIQ-(α-Me-2,6-F-Phe)-Nle-HQ-Orn-A-Arg(NO$_2$)-(α-Me—2F-Phe) |
| 336 | (AC$_5$C)-V-Aib-EIQ-(α-Me-2,6-F-Phe)-Nle-HQ-Orn-Aib-Arg(NO$_2$)-(α-Me—2F-Phe) |

TABLE 2 (ix)-continued

List of short-chain peptides prepared

| Seq. ID. No. | Sequence of short-chain peptides |
|---|---|
| 337 | Aib-V-Aib-EIQ-(α-Me—2F-Phe)-Nle-HQ-Orn-A-Arg(NO₂)-(α-Me-2,6-F-Phe) |
| 338 | Aib-V-Aib-EIQ-(α-Me—2F-Phe)-Nle-HQ-Orn-Aib-Arg(NO₂)-(α-Me-2,6-F-Phe) |
| 339 | (AC₅C)-V-Aib-EIQ-(α-Me—2F-Phe)-Nle-HQ-Orn-A-Arg(NO₂)-(α-Me-2,6-F-Phe) |
| 340 | (AC₅C)-V-Aib-EIQ-(α-Me—2F-Phe)-Nle-HQ-Orn-Aib-Arg(NO₂)-(α-Me-2,6-F-Phe) |
| 341 | Aib-V-Aib-EIQ-(α-Me-2,6-F-Phe)-Nle-HQ-Orn-A-Arg(NO₂)-(α-Me-2,6-F-Phe) |
| 342 | Aib-V-Aib-EIQ-(α-Me-2,6-F-Phe)-Nle-HQ-Orn-Aib-Arg(NO₂)-(α-Me-2,6-F-Phe) |
| 343 | (AC₅C)-V-Aib-EIQ-(α-Me-2,6-F-Phe)-Nle-HQ-Orn-A-Arg(NO₂)-(α-Me-2,6-F-Phe) |
| 344 | (AC₅C)-V-Aib-EIQ-(α-Me-2,6-F-Phe)-Nle-HQ-Orn-Aib-Arg(NO₂)-(α-Me-2,6-F-Phe) |

TABLE 2 (x)

List of short-chain peptides prepared

| Seq. ID. No. | Sequence of short-chain peptides |
|---|---|
| 345 | Aib-V-Aib-EIQ-(α-Me—2F-Phe)-Nle-HQ-Cit-A-Cit-(α-Me—2F-Phe) |
| 346 | Aib-V-Aib-EIQ-(α-Me—2F-Phe)-Nle-HQ-Cit-Aib-Cit-(α-Me—2F-Phe) |
| 347 | (AC₅C)-V-Aib-EIQ-(α-Me—2F-Phe)-Nle-HQ-Cit-A-Cit-(α-Me—2F-Phe) |
| 348 | (AC₅C)-V-Aib-EIQ-(α-Me—2F-Phe)-Nle-HQ-Cit-Aib-Cit-(α-Me—2F-Phe) |
| 349 | Aib-V-Aib-EIQ-(α-Me-2,6-F-Phe)-Nle-HQ-Cit-A-Cit-(α-Me—2F-Phe) |
| 350 | Aib-V-Aib-EIQ-(α-Me-2,6-F-Phe)-Nle-HQ-Cit-Aib-Cit-(α-Me—2F-Phe) |
| 351 | (AC₅C)-V-Aib-EIQ-(α-Me-2,6-F-Phe)-Nle-HQ-Cit-A-Cit-(α-Me—2F-Phe) |
| 352 | (AC₅C)-V-Aib-EIQ-(α-Me-2,6-F-Phe)-Nle-HQ-Cit-Aib-Cit-(α-Me—2F-Phe) |
| 353 | Aib-V-Aib-EIQ-(α-Me—2F-Phe)-Nle-HQ-Cit-A-Cit-(α-Me-2,6-F-Phe) |
| 354 | Aib-V-Aib-EIQ-(α-Me—2F-Phe)-Nle-HQ-Cit-Aib-Cit-(α-Me-2,6-F-Phe) |
| 355 | (AC₅C)-V-Aib-EIQ-(α-Me—2F-Phe)-Nle-HQ-Cit-A-Cit-(α-Me-2,6-F-Phe) |
| 356 | (AC₅C)-V-Aib-EIQ-(α-Me—2F-Phe)-Nle-HQ-Cit-Aib-Cit-(α-Me-2,6-F-Phe) |
| 357 | Aib-V-Aib-EIQ-(α-Me-2,6-F-Phe)-Nle-HQ-Cit-A-Cit-(α-Me-2,6-F-Phe) |
| 358 | Aib-V-Aib-EIQ-(α-Me-2,6-F-Phe)-Nle-HQ-Cit-Aib-Cit-(α-Me-2,6-F-Phe) |
| 359 | (AC₅C)-V-Aib-EIQ-(α-Me-2,6-F-Phe)-Nle-HQ-Cit-A-Cit-(α-Me-2,6-F-Phe) |
| 360 | (AC₅C)-V-Aib-EIQ-(α-Me-2,6-F-Phe)-Nle-HQ-Cit-Aib-Cit-(α-Me-2,6-F-Phe) |
| 361 | Aib-V-Aib-EIQ-(α-Me—2F-Phe)-Nle-HQ-Cit-A-Aib-(α-Me—2F-Phe) |
| 362 | Aib-V-Aib-EIQ-(α-Me—2F-Phe)-Nle-HQ-Cit-Aib-Aib-(α-Me—2F-Phe) |
| 363 | (AC₅C)-V-Aib-EIQ-(α-Me—2F-Phe)-Nle-HQ-Cit-A-Aib-(α-Me—2F-Phe) |
| 364 | (AC₅C)-V-Aib-EIQ-(α-Me—2F-Phe)-Nle-HQ-Cit-Aib-Aib-(α-Me—2F-Phe) |
| 365 | Aib-V-Aib-EIQ-(α-Me-2,6-F-Phe)-Nle-HQ-Cit-A-Aib-(α-Me—2F-Phe) |

TABLE 2 (x)-continued

List of short-chain peptides prepared

| Seq. ID. No. | Sequence of short-chain peptides |
|---|---|
| 366 | Aib-V-Aib-EIQ-(α-Me-2,6-F-Phe)-Nle-HQ-Cit-Aib-Aib-(α-Me-2F-Phe) |
| 367 | (AC$_5$C)-V-Aib-EIQ-(α-Me-2,6-F-Phe)-Nle-HQ-Cit-A-Aib-(α-Me—2F-Phe) |
| 368 | (AC$_5$C)-V-Aib-EIQ-(α-Me-2,6-F-Phe)-Nle-HQ-Cit-Aib-Aib-(α-Me—2F-Phe) |
| 369 | Aib-V-Aib-EIQ-(α-Me—2F-Phe)-Nle-HQ-Cit-A-Aib-(α-Me-2,6-F-Phe) |
| 370 | Aib-V-Aib-EIQ-(α-Me—2F-Phe)-Nle-HQ-Cit-Aib-Aib-(α-Me-2,6-F-Phe) |
| 371 | (AC$_5$C)-V-Aib-EIQ-(α-Me—2F-Phe)-Nle-HQ-Cit-A-Aib-(α-Me-2,6-F-Phe) |
| 372 | (AC$_5$C)-V-Aib-EIQ-(α-Me—2F-Phe)-Nle-HQ-Cit-Aib-Aib-(α-Me-2,6-F-Phe) |
| 373 | Aib-V-Aib-EIQ-(α-Me-2,6-F-Phe)-Nle-HQ-Cit-A-Aib-(α-Me-2,6-F-Phe) |
| 374 | Aib-V-Aib-EIQ-(α-Me-2,6-F-Phe)-Nle-HQ-Cit-Aib-Aib-(α-Me-2,6-F-Phe) |
| 375 | (AC$_5$C)-V-Aib-EIQ-(α-Me-2,6-F-Phe)-Nle-HQ-Cit-A-Aib-(α-Me-2,6-F-Phe) |
| 376 | (AC$_5$C)-V-Aib-EIQ-(α-Me-2,6-F-Phe)-Nle-HQ-Cit-Aib-Aib-(α-Me-2,6-F-Phe) |
| 377 | Aib-V-Aib-EIQ-(α-Me—2F-Phe)-Nle-HQ-Cit-A-(α-Me-2,6-F-Phe)-(α-Me—2F-Phe) |
| 378 | Aib-V-Aib-EIQ-(α-Me—2F-Phe)-Nle-HQ-Cit-Aib-(α-Me-2,6-F-Phe)-(α-Me-2F-Phe) |
| 379 | (AC$_5$C)-V-Aib-EIQ-(α-Me—2F-Phe)-Nle-HQ-Cit-A-(α-Me-2,6-F-Phe)-(α-Me-2F-Phe) |
| 380 | (AC$_5$C)-V-Aib-EIQ-(α-Me—2F-Phe)-Nle-HQ-Cit-Aib-(α-Me-2,6-F-Phe)-(α-Me—2F-Phe) |
| 381 | Aib-V-Aib-EIQ-(α-Me-2,6-F-Phe)-Nle-HQ-Cit-A-(α-Me-2,6-F-Phe)-(α-Me-2F-Phe) |
| 382 | Aib-V-Aib-EIQ-(α-Me-2,6-F-Phe)-Nle-HQ-Cit-Aib-(α-Me-2,6-F-Phe)-(α-Me-2F-Phe) |
| 383 | (AC$_5$C)-V-Aib-EIQ-(α-Me-2,6-F-Phe)-Nle-HQ-Cit-A-(α-Me-2,6-F-Phe)-(α-Me—2F-Phe) |
| 384 | (AC$_5$C)-V-Aib-EIQ-(α-Me-2,6-F-Phe)-Nle-HQ-Cit-Aib-(α-Me-2,6-F-Phe)-(α-Me—2F-Phe) |
| 385 | Aib-V-Aib-EIQ-(α-Me—2F-Phe)-Nle-HQ-Cit-A-(α-Me-2,6-F-Phe)-(α-Me-2,6-F-Phe) |
| 386 | Aib-V-Aib-EIQ-(α-Me—2F-Phe)-Nle-HQ-Cit-Aib-(α-Me-2,6-F-Phe)-(α-Me-2,6-F-Phe) |
| 387 | (AC$_5$C)-V-Aib-EIQ-(α-Me—2F-Phe)-Nle-HQ-Cit-A-(α-Me-2,6-F-Phe)-(α-Me-2,6-F-Phe) |
| 388 | (AC$_5$C)-V-Aib-EIQ-(α-Me—2F-Phe)-Nle-HQ-Cit-Aib-(α-Me-2,6-F-Phe)-(α-Me-2,6-F-Phe) |
| 389 | Aib-V-Aib-EIQ-(α-Me-2,6-F-Phe)-Nle-HQ-Cit-A-(α-Me-2,6-F-Phe)-(α-Me-2,6-F-Phe) |
| 390 | Aib-V-Aib-EIQ-(α-Me-2,6-F-Phe)-Nle-HQ-Cit-Aib-(α-Me-2,6-F-Phe)-(α-Me-2,6-F-Phe) |
| 391 | (AC$_5$C)-V-Aib-EIQ-(α-Me-2,6-F-Phe)-Nle-HQ-Cit-A-(α-Me-2,6-F-Phe)-(α-Me-2,6-F-Phe) |
| 392 | (AC$_5$C)-V-Aib-EIQ-(α-Me-2,6-F-Phe)-Nle-HQ-Cit-Aib-(α-Me-2,6-F-Phe)-(α-Me-2,6-F-Phe) |
| 393 | Aib-V-Aib-EIQ-(α-Me—2F-Phe)-Nle-HQ-Cit-A-Arg(NO$_2$)-(α-Me—2F-Phe) |
| 394 | Aib-V-Aib-EIQ-(α-Me—2F-Phe)-Nle-HQ-Cit-Aib-Arg(NO$_2$)-(α-Me—2F-Phe) |
| 395 | (AC$_5$C)-V-Aib-EIQ-(α-Me—2F-Phe)-Nle-HQ-Cit-A-Arg(NO$_2$)-(α-Me—2F-Phe) |

TABLE 2 (x)-continued

List of short-chain peptides prepared

| Seq. ID. No. | Sequence of short-chain peptides |
| --- | --- |
| 396 | (AC₅C)-V-Aib-EIQ-(α-Me—2F-Phe)-Nle-HQ-Cit-Aib-Arg(NO₂)-(α-Me—2F-Phe) |
| 397 | Aib-V-Aib-EIQ-(α-Me-2,6-F-Phe)-Nle-HQ-Cit-A-Arg(NO₂)-(α-Me—2F-Phe) |
| 398 | Aib-V-Aib-EIQ-(α-Me-2,6-F-Phe)-Nle-HQ-Cit-Aib-Arg(NO₂)-(α-Me—2F-Phe) |
| 399 | (AC₅C)-V-Aib-EIQ-(α-Me-2,6-F-Phe)-Nle-HQ-Cit-A-Arg(NO₂)-(α-Me—2F-Phe) |
| 400 | (AC₅C)-V-Aib-EIQ-(α-Me-2,6-F-Phe)-Nle-HQ-Cit-Aib-Arg(NO₂)-(α-Me—2F-Phe) |
| 401 | Aib-V-Aib-EIQ-(α-Me—2F-Phe)-Nle-HQ-Cit-A-Arg(NO₂)-(α-Me-2,6-F-Phe) |
| 402 | Aib-V-Aib-EIQ-(α-Me—2F-Phe)-Nle-HQ-Cit-Aib-Arg(NO₂)-(α-Me-2,6-F-Phe) |
| 403 | (AC₅C)-V-Aib-EIQ-(α-Me—2F-Phe)-Nle-HQ-Cit-A-Arg(NO₂)-(α-Me-2,6-F-Phe) |
| 404 | (AC₅C)-V-Aib-EIQ-(α-Me—2F-Phe)-Nle-HQ-Cit-Aib-Arg(NO₂)-(α-Me-2,6-F-Phe) |
| 405 | Aib-V-Aib-EIQ-(α-Me-2,6-F-Phe)-Nle-HQ-Cit-A-Arg(NO₂)-(α-Me-2,6-F-Phe) |
| 406 | Aib-V-Aib-EIQ-(α-Me-2,6-F-Phe)-Nle-HQ-Cit-Aib-Arg(NO₂)-(α-Me-2,6-F-Phe) |
| 407 | (AC₅C)-V-Aib-EIQ-(α-Me-2,6-F-Phe)-Nle-HQ-Cit-A-Arg(NO₂)-(α-Me-2,6-F-Phe) |
| 408 | (AC₅C)-V-Aib-EIQ-(α-Me-2,6-F-Phe)-Nle-HQ-Cit-Aib-Arg(NO₂)-(α-Me-2,6-F-Phe) |

TABLE 2 (xi)

List of short-chain peptides prepared

| Seq. ID. No. | Sequence of short-chain peptides |
| --- | --- |
| 409 | Aib-V-Aib-EIQ-(α-Me—2F-Phe)-Nle-HQ-(HoCit)-A-Cit-(α-Me—2F-Phe) |
| 410 | Aib-V-Aib-EIQ-(α-Me—2F-Phe)-Nle-HQ-(HoCit)-Aib-Cit-(α-Me—2F-Phe) |
| 411 | (AC₅C)-V-Aib-EIQ-(α-Me—2F-Phe)-Nle-HQ-(HoCit)-A-Cit-(α-Me—2F-Phe) |
| 412 | (AC₅C)-V-Aib-EIQ-(α-Me—2F-Phe)-Nle-HQ-(HoCit)-Aib-Cit-(α-Me—2F-Phe) |
| 413 | Aib-V-Aib-EIQ-(α-Me-2,6-F-Phe)-Nle-HQ-(HoCit)-A-Cit-(α-Me—2F-Phe) |
| 414 | Aib-V-Aib-EIQ-(α-Me-2,6-F-Phe)-Nle-HQ-(HoCit)-Aib-Cit-(α-Me—2F-Phe) |
| 415 | (AC₅C)-V-Aib-EIQ-(α-Me-2,6-F-Phe)-Nle-HQ-(HoCit)-A-Cit-(α-Me—2F-Phe) |
| 416 | (AC₅C)-V-Aib-EIQ-(α-Me-2,6-F-Phe)-Nle-HQ-(HoCit)-Aib-Cit-(α-Me—2F-Phe) |
| 417 | Aib-V-Aib-EIQ-(α-Me—2F-Phe)-Nle-HQ-(HoCit)-A-Cit-(α-Me-2,6-F-Phe) |
| 418 | Aib-V-Aib-EIQ-(α-Me—2F-Phe)-Nle-HQ-(HoCit)-Aib-Cit-(α-Me-2,6-F-Phe) |
| 419 | (AC₅C)-V-Aib-EIQ-(α-Me—2F-Phe)-Nle-HQ-(HoCit)-A-Cit-(α-Me-2,6-F-Phe) |
| 420 | (AC₅C)-V-Aib-EIQ-(α-Me—2F-Phe)-Nle-HQ-(HoCit)-Aib-Cit-(α-Me-2,6-F-Phe) |
| 421 | Aib-V-Aib-EIQ-(α-Me-2,6-F-Phe)-Nle-HQ-(HoCit)-A-Cit-(α-Me-2,6-F-Phe) |
| 422 | Aib-V-Aib-EIQ-(α-Me-2,6-F-Phe)-Nle-HQ-(HoCit)-Aib-Cit-(α-Me-2,6-F-Phe) |

TABLE 2 (xi)-continued

List of short-chain peptides prepared

| Seq. ID. No. | Sequence of short-chain peptides |
|---|---|
| 423 | (AC$_5$C)-V-Aib-EIQ-(α-Me-2,6-F-Phe)-Nle-HQ-(HoCit)-A-Cit-(α-Me-2,6-F-Phe) |
| 424 | (AC$_5$C)-V-Aib-EIQ-(α-Me-2,6-F-Phe)-Nle-HQ-(HoCit)-Aib-Cit-(α-Me-2,6-F-Phe) |
| 425 | Aib-V-Aib-EIQ-(α-Me—2F-Phe)-Nle-HQ-(HoCit)-A-Aib-(α-Me—2F-Phe) |
| 426 | Aib-V-Aib-EIQ-(α-Me—2F-Phe)-Nle-HQ-(HoCit)-Aib-Aib-(α-Me—2F-Phe) |
| 427 | (AC$_5$C)-V-Aib-EIQ-(α-Me—2F-Phe)-Nle-HQ-(HoCit)-A-Aib-(α-Me—2F-Phe) |
| 428 | (AC$_5$C)-V-Aib-EIQ-(α-Me—2F-Phe)-Nle-HQ-(HoCit)-Aib-Aib-(α-Me—2F-Phe) |
| 429 | Aib-V-Aib-EIQ-(α-Me-2,6-F-Phe)-Nle-HQ-(HoCit)-A-Aib-(α-Me—2F-Phe) |
| 430 | Aib-V-Aib-EIQ-(α-Me-2,6-F-Phe)-Nle-HQ-(HoCit)-Aib-Aib-(α-Me—2F-Phe) |
| 431 | (AC$_5$C)-V-Aib-EIQ-(α-Me-2,6-F-Phe)-Nle-HQ-(HoCit)-A-Aib-(α-Me—2F-Phe) |
| 432 | (AC$_5$C)-V-Aib-EIQ-(α-Me-2,6-F-Phe)-Nle-HQ-(HoCit)-Aib-Aib-(α-Me—2F-Phe) |
| 433 | Aib-V-Aib-EIQ-(α-Me—2F-Phe)-Nle-HQ-(HoCit)-A-Aib-(α-Me-2,6-F-Phe) |
| 434 | Aib-V-Aib-EIQ-(α-Me—2F-Phe)-Nle-HQ-(HoCit)-Aib-Aib-(α-Me-2,6-F-Phe) |
| 435 | (AC$_5$C)-V-Aib-EIQ-(α-Me—2F-Phe)-Nle-HQ-(HoCit)-A-Aib-(α-Me-2,6-F-Phe) |
| 436 | (AC$_5$C)-V-Aib-EIQ-(α-Me—2F-Phe)-Nle-HQ-(HoCit)-Aib-Aib-(α-Me-2,6-F-Phe) |
| 437 | Aib-V-Aib-EIQ-(α-Me-2,6-F-Phe)-Nle-HQ-(HoCit)-A-Aib-(α-Me-2,6-F-Phe) |
| 438 | Aib-V-Aib-EIQ-(α-Me-2,6-F-Phe)-Nle-HQ-(HoCit)-Aib-Aib-(α-Me-2,6-F-Phe) |
| 439 | (AC$_5$C)-V-Aib-EIQ-(α-Me-2,6-F-Phe)-Nle-HQ-(HoCit)-A-Aib-(α-Me-2,6-F-Phe) |
| 440 | (AC$_5$C)-V-Aib-EIQ-(α-Me-2,6-F-Phe)-Nle-HQ-(HoCit)-Aib-Aib-(α-Me-2,6-F-Phe) |
| 441 | Aib-V-Aib-EIQ-(α-Me—2F-Phe)-Nle-HQ-(HoCit)-A-(α-Me-2,6-F-Phe)-(α-Me-2F-Phe) |
| 442 | Aib-V-Aib-EIQ-(α-Me—2F-Phe)-Nle-HQ-(HoCit)-Aib-(α-Me-2,6-F-Phe)-(α-Me—2F-Phe) |
| 443 | (AC$_5$C)-V-Aib-EIQ-(α-Me—2F-Phe)-Nle-HQ-(HoCit)-A-(α-Me-2,6-F-Phe)-(α-Me—2F-Phe) |
| 444 | (AC$_5$C)-V-Aib-EIQ-(α-Me—2F-Phe)-Nle-HQ-(HoCit)-Aib-(α-Me-2,6-F-Phe)-(α-Me—2F-Phe) |
| 445 | Aib-V-Aib-EIQ-(α-Me-2,6-F-Phe)-Nle-HQ-(HoCit)-A-(α-Me-2,6-F-Phe)-(α-Me—2F-Phe) |
| 446 | Aib-V-Aib-EIQ-(α-Me-2,6-F-Phe)-Nle-HQ-(HoCit)-Aib-(α-Me-2,6-F-Phe)-(α-Me—2F-Phe) |
| 447 | (AC$_5$C)-V-Aib-EIQ-(α-Me-2,6-F-Phe)-Nle-HQ-(HoCit)-A-(α-Me-2,6-F-Phe)-(α-Me—2F-Phe) |
| 448 | (AC$_5$C)-V-Aib-EIQ-(α-Me-2,6-F-Phe)-Nle-HQ-(HoCit)-Aib-(α-Me-2,6-F-Phe)-(α-Me—2F-Phe) |
| 449 | Aib-V-Aib-EIQ-(α-Me—2F-Phe)-Nle-HQ-(HoCit)-A-(α-Me-2,6-F-Phe)-(α-Me-2,6-F-Phe) |
| 450 | Aib-V-Aib-EIQ-(α-Me—2F-Phe)-Nle-HQ-(HoCit)-Aib-(α-Me-2,6-F-Phe)-(α-Me-2,6-F-Phe) |
| 451 | (AC$_5$C)-V-Aib-EIQ-(α-Me—2F-Phe)-Nle-HQ-(HoCit)-A-(α-Me-2,6-F-Phe)-(α-Me-2,6-F-Phe) |

TABLE 2 (xi)-continued

List of short-chain peptides prepared

| Seq. ID. No. | Sequence of short-chain peptides |
|---|---|
| 452 | (AC$_5$C)-V-Aib-EIQ-(α-Me—2F-Phe)-Nle-HQ-(HoCit)-Aib-(α-Me-2,6-F-Phe)-(α-Me-2,6-F-Phe) |
| 453 | Aib-V-Aib-EIQ-(α-Me-2,6-F-Phe)-Nle-HQ-(HoCit)-A-(α-Me-2,6-F-Phe)-(α-Me-2,6-F-Phe) |
| 454 | Aib-V-Aib-EIQ-(α-Me-2,6-F-Phe)-Nle-HQ-(HoCit)-Aib-(α-Me-2,6-F-Phe)-(α-Me-2,6-F-Phe) |
| 455 | (AC$_5$C)-V-Aib-EIQ-(α-Me-2,6-F-Phe)-Nle-HQ-(HoCit)-A-(α-Me-2,6-F-Phe)-(α-Me-2,6-F-Phe) |
| 456 | (AC$_5$C)-V-Aib-EIQ-(α-Me-2,6-F-Phe)-Nle-HQ-(HoCit)-Aib-(α-Me-2,6-F-Phe)-(α-Me-2,6-F-Phe) |
| 457 | Aib-V-Aib-EIQ-(α-Me—2F-Phe)-Nle-HQ-(HoCit)-A-Arg(NO$_2$)-(α-Me—2F-Phe) |
| 458 | Aib-V-Aib-EIQ-(α-Me—2F-Phe)-Nle-HQ-(HoCit)-Aib-Arg(NO$_2$)-(α-Me—2F-Phe) |
| 459 | (AC$_5$C)-V-Aib-EIQ-(α-Me—2F-Phe)-Nle-HQ-(HoCit)-A-Arg(NO$_2$)-(α-Me—2F-Phe) |
| 460 | (AC$_5$C)-V-Aib-EIQ-(α-Me—2F-Phe)-Nle-HQ-(HoCit)-Aib-Arg(NO$_2$)-(α-Me-2F-Phe) |
| 461 | Aib-V-Aib-EIQ-(α-Me-2,6-F-Phe)-Nle-HQ-(HoCit)-A-Arg(NO$_2$)-(α-Me—2F-Phe) |
| 462 | Aib-V-Aib-EIQ-(α-Me-2,6-F-Phe)-Nle-HQ-(HoCit)-Aib-Arg(NO$_2$)-(α-Me—2F-Phe) |
| 463 | (AC$_5$C)-V-Aib-EIQ-(α-Me-2,6-F-Phe)-Nle-HQ-(HoCit)-A-Arg(NO$_2$)-(α-Me-2F-Phe) |
| 464 | (AC$_5$C)-V-Aib-EIQ-(α-Me-2,6-F-Phe)-Nle-HQ-(HoCit)-Aib-Arg(NO$_2$)-(α-Me-2F-Phe) |
| 465 | Aib-V-Aib-EIQ-(α-Me—2F-Phe)-Nle-HQ-(HoCit)-A-Arg(NO$_2$)-(α-Me-2,6-F-Phe) |
| 466 | Aib-V-Aib-EIQ-(α-Me—2F-Phe)-Nle-HQ-(HoCit)-Aib-Arg(NO$_2$)-(α-Me-2,6-F-Phe) |
| 467 | (AC$_5$C)-V-Aib-EIQ-(α-Me—2F-Phe)-Nle-HQ-(HoCit)-A-Arg(NO$_2$)-(α-Me-2,6-F-Phe) |
| 468 | (AC$_5$C)-V-Aib-EIQ-(α-Me—2F-Phe)-Nle-EIQ-(HoCit)-Aib-Arg(NO$_2$)-(α-Me-2,6-F-Phe) |
| 469 | Aib-V-Aib-EIQ-(α-Me-2,6-F-Phe)-Nle-HQ-(HoCit)-A-Arg(NO$_2$)-(α-Me-2,6-F-Phe) |
| 470 | Aib-V-Aib-EIQ-(α-Me-2,6-F-Phe)-Nle-HQ-(HoCit)-Aib-Arg(NO$_2$)-(α-Me-2,6-F-Phe) |
| 471 | (AC$_5$C)-V-Aib-EIQ-(α-Me-2,6-F-Phe)-Nle-HQ-(HoCit)-A-Arg(NO$_2$)-(α-Me-2,6-F-Phe) |
| 472 | (AC$_5$C)-V-Aib-EIQ-(α-Me-2,6-F-Phe)-Nle-HQ-(HoCit)-Aib-Arg(NO$_2$)-(α-Me-2,6-F-Phe) |

TABLE 2 (xii)

List of short-chain peptides prepared

| Seq. ID. No. | Sequence of short-chain peptides |
|---|---|
| 473 | Aib-V-Aib-EIQ-(α-Me—2F-Phe)-Nle-HQ-(α-Me-2,6-F-Phe)-A-Cit-(α-Me—2F-Phe) |
| 474 | Aib-V-Aib-EIQ-(α-Me—2F-Phe)-Nle-HQ-(α-Me-2,6-F-Phe)-Aib-Cit-(α-Me-2F-Phe) |
| 475 | (AC$_5$C)-V-Aib-EIQ-(α-Me—2F-Phe)-Nle-HQ-(α-Me-2,6-F-Phe)-A-Cit-(α-Me-2F-Phe) |
| 476 | (AC$_5$C)-V-Aib-EIQ-(α-Me—2F-Phe)-Nle-HQ-(α-Me-2,6-F-Phe)-Aib-Cit-(α-Me—2F-Phe) |
| 477 | Aib-V-Aib-EIQ-(α-Me-2,6-F-Phe)-Nle-HQ-(α-Me-2,6-F-Phe)-A-Cit-(α-Me-2F-Phe) |
| 478 | Aib-V-Aib-EIQ-(α-Me-2,6-F-Phe)-Nle-HQ-(α-Me-2,6-F-Phe)-Aib-Cit-(α-Me-2F-Phe) |
| 479 | (AC$_5$C)-V-Aib-EIQ-(α-Me-2,6-F-Phe)-Nle-HQ-(α-Me-2,6-F-Phe)-A-Cit-(α-Me-2F-Phe) |
| 480 | (AC$_5$C)-V-Aib-EIQ-(α-Me-2,6-F-Phe)-Nle-HQ-(α-Me-2,6-F-Phe)-Aib-Cit-(α-Me—2F-Phe) |
| 481 | Aib-V-Aib-EIQ-(α-Me—2F-Phe)-Nle-HQ-(α-Me-2,6-F-Phe)-A-Cit-(α-Me-2,6-F-Phe) |
| 482 | Aib-V-Aib-EIQ-(α-Me—2F-Phe)-Nle-HQ-(α-Me-2,6-F-Phe)-Aib-Cit-(α-Me-2,6-F-Phe) |
| 483 | (AC$_5$C)-V-Aib-EIQ-(α-Me—2F-Phe)-Nle-HQ-(α-Me-2,6-F-Phe)-A-Cit-(α-Me-2,6-F-Phe) |
| 484 | (AC$_5$C)-V-Aib-EIQ-(α-Me—2F-Phe)-Nle-HQ-(α-Me-2,6-F-Phe)-Aib-Cit-(α-Me-2,6-F-Phe) |
| 485 | Aib-V-Aib-EIQ-(α-Me-2,6-F-Phe)-Nle-HQ-(α-Me-2,6-F-Phe)-A-Cit-(α-Me-2,6-F-Phe) |
| 486 | Aib-V-Aib-EIQ-(α-Me-2,6-F-Phe)-Nle-HQ-(α-Me-2,6-F-Phe)-Aib-Cit-(α-Me-2,6-F-Phe) |
| 487 | (AC$_5$C)-V-Aib-EIQ-(α-Me-2,6-F-Phe)-Nle-HQ-(α-Me-2,6-F-Phe)-A-Cit-(α-Me-2,6-F-Phe) |
| 488 | (AC$_5$C)-V-Aib-EIQ-(α-Me-2,6-F-Phe)-Nle-HQ-(α-Me-2,6-F-Phe)-Aib-Cit-(α-Me-2,6-F-Phe) |
| 489 | Aib-V-Aib-EIQ-(α-Me—2F-Phe)-Nle-HQ-(α-Me-2,6-F-Phe)-A-Aib-(α-Me—2F-Phe) |
| 490 | Aib-V-Aib-EIQ-(α-Me—2F-Phe)-Nle-HQ-(α-Me-2,6-F-Phe)-Aib-Aib-(α-Me-2F-Phe) |
| 491 | (AC$_5$C)-V-Aib-EIQ-(α-Me—2F-Phe)-Nle-HQ-(α-Me-2,6-F-Phe)-A-Aib-(α-Me-2F-Phe) |
| 492 | (AC$_5$C)-V-Aib-EIQ-(α-Me—2F-Phe)-Nle-HQ-(α-Me-2,6-F-Phe)-Aib-Aib-(α-Me—2F-Phe) |
| 493 | Aib-V-Aib-EIQ-(α-Me-2,6-F-Phe)-Nle-HQ-(α-Me-2,6-F-Phe)-A-Aib-(α-Me-2F-Phe) |
| 494 | Aib-V-Aib-EIQ-(α-Me-2,6-F-Phe)-Nle-HQ-(α-Me-2,6-F-Phe)-Aib-Aib-(α-Me—2F-Phe) |
| 495 | (AC$_5$C)-V-Aib-EIQ-(α-Me-2,6-F-Phe)-Nle-HQ-(α-Me-2,6-F-Phe)-A-Aib-(α-Me—2F-Phe) |
| 496 | (AC$_5$C)-V-Aib-EIQ-(α-Me-2,6-F-Phe)-Nle-HQ-(α-Me-2,6-F-Phe)-Aib-Aib-(α-Me—2F-Phe) |
| 497 | Aib-V-Aib-EIQ-(α-Me—2F-Phe)-Nle-FlQ-(α-Me-2,6-F-Phe)-A-Aib-(α-Me-2,6-F-Phe) |

TABLE 2 (xii)-continued

List of short-chain peptides prepared

| Seq. ID. No. | Sequence of short-chain peptides |
|---|---|
| 498 | Aib-V-Aib-EIQ-(α-Me—2F-Phe)-Nle-HQ-(α-Me-2,6-F-Phe)-Aib-Aib-(α-Me-2,6-F-Phe) |
| 499 | (AC₅C)-V-Aib-EIQ-(α-Me—2F-Phe)-Nle-HQ-(α-Me-2,6-F-Phe)-A-Aib-(α-Me-2,6-F-Phe) |
| 500 | (AC₅C)-V-Aib-EIQ-(α-Me—2F-Phe)-Nle-HQ-(α-Me-2,6-F-Phe)-Aib-Aib-(α-Me-2,6-F-Phe) |
| 501 | Aib-V-Aib-EIQ-(α-Me-2,6-F-Phe)-Nle-HQ-(α-Me-2,6-F-Phe)-A-Aib-(α-Me-2,6-F-Phe) |
| 502 | Aib-V-Aib-EIQ-(α-Me-2,6-F-Phe)-Nle-HQ-(α-Me-2,6-F-Phe)-Aib-Aib-(α-Me-2,6-F-Phe) |
| 503 | (AC₅C)-V-Aib-EIQ-(α-Me-2,6-F-Phe)-Nle-HQ-(α-Me-2,6-F-Phe)-A-Aib-(α-Me-2,6-F-Phe) |
| 504 | (AC₅C)-V-Aib-EIQ-(α-Me-2,6-F-Phe)-Nle-HQ-(α-Me-2,6-F-Phe)-Aib-Aib-(α-Me-2,6-F-Phe) |
| 505 | Aib-V-Aib-EIQ-(α-Me—2F-Phe)-Nle-HQ-(α-Me-2,6-F-Phe)-A-(α-Me-2,6-F-Phe)-(α-Me—2F-Phe) |
| 506 | Aib-V-Aib-EIQ-(α-Me—2F-Phe)-Nle-HQ-(α-Me-2,6-F-Phe)-Aib-(α-Me-2,6-F-Phe)-(α-Me—2F-Phe) |
| 507 | (AC₅C)-V-Aib-EIQ-(α-Me—2F-Phe)-Nle-HQ-(α-Me-2,6-F-Phe)-A-(α-Me-2,6-F-Phe)-(α-Me—2F-Phe) |
| 508 | (AC₅C)-V-Aib-EIQ-(α-Me—2F-Phe)-Nle-HQ-(α-Me-2,6-F-Phe)-Aib-(α-Me-2,6-F-Phe)-(α-Me—2F-Phe) |
| 509 | Aib-V-Aib-EIQ-(α-Me-2,6-F-Phe)-Nle-HQ-(α-Me-2,6-F-Phe)-A-(α-Me-2,6-F-Phe)-(α-Me—2F-Phe) |
| 510 | Aib-V-Aib-EIQ-(α-Me-2,6-F-Phe)-Nle-HQ-(α-Me-2,6-F-Phe)-Aib-(α-Me-2,6-F-Phe)-(α-Me—2F-Phe) |
| 511 | (AC₅C)-V-Aib-EIQ-(α-Me-2,6-F-Phe)-Nle-HQ-(α-Me-2,6-F-Phe)-A-(α-Me-2,6-F-Phe)-(α-Me—2F-Phe) |
| 512 | (AC₅C)-V-Aib-EIQ-(α-Me-2,6-F-Phe)-Nle-HQ-(α-Me-2,6-F-Phe)-Aib-(α-Me-2,6-F-Phe)-(α-Me—2F-Phe) |
| 513 | Aib-V-Aib-EIQ-(α-Me—2F-Phe)-Nle-HQ-(α-Me-2,6-F-Phe)-A-(α-Me-2,6-F-Phe)-(α-Me-2,6-F-Phe) |
| 514 | Aib-V-Aib-EIQ-(α-Me—2F-Phe)-Nle-HQ-(α-Me-2,6-F-Phe)-Aib-(α-Me-2,6-F-Phe)-(α-Me-2,6-F-Phe) |
| 515 | (AC₅C)-V-Aib-EIQ-(α-Me—2F-Phe)-Nle-HQ-(α-Me-2,6-F-Phe)-A-(α-Me-2,6-F-Phe)-(α-Me-2,6-F-Phe) |
| 516 | (AC₅C)-V-Aib-EIQ-(α-Me—2F-Phe)-Nle-HQ-(α-Me-2,6-F-Phe)-Aib-(α-Me-2,6-F-Phe)-(α-Me-2,6-F-Phe) |
| 517 | Aib-V-Aib-EIQ-(α-Me-2,6-F-Phe)-Nle-HQ-(α-Me-2,6-F-Phe)-A-(α-Me-2,6-F-Phe)-(α-Me-2,6-F-Phe) |
| 518 | Aib-V-Aib-EIQ-(α-Me-2,6-F-Phe)-Nle-HQ-(α-Me-2,6-F-Phe)-Aib-(α-Me-2,6-F-Phe)-(α-Me-2,6-F-Phe) |
| 519 | (AC₅C)-V-Aib-EIQ-(α-Me-2,6-F-Phe)-Nle-HQ-(α-Me-2,6-F-Phe)-A-(α-Me-2,6-F-Phe)-(α-Me-2,6-F-Phe) |
| 520 | (AC₅C)-V-Aib-EIQ-(α-Me-2,6-F-Phe)-Nle-HQ-(α-Me-2,6-F-Phe)-Aib-(α-Me-2,6-F-Phe)-(α-Me-2,6-F-Phe) |
| 521 | Aib-V-Aib-EIQ-(α-Me—2F-Phe)-Nle-HQ-(α-Me-2,6-F-Phe)-A-Arg(NO₂)-(α-Me—2F-Phe) |
| 522 | Aib-V-Aib-EIQ-(α-Me—2F-Phe)-Nle-HQ-(α-Me-2,6-F-Phe)-Aib-Arg(NO₂)-(α-Me—2F-Phe) |

TABLE 2 (xii)-continued

List of short-chain peptides prepared

| Seq. ID. No. | Sequence of short-chain peptides |
|---|---|
| 523 | (AC$_5$C)-V-Aib-EIQ-(α-Me—2F-Phe)-Nle-HQ-(α-Me-2,6-F-Phe)-A-Arg(NO$_2$)-(α-Me—2F-Phe) |
| 524 | (AC$_5$C)-V-Aib-EIQ-(α-Me—2F-Phe)-Nle-HQ-(α-Me-2,6-F-Phe)-Aib-Arg(NO$_2$)-(α-Me—2F-Phe) |
| 525 | Aib-V-Aib-EIQ-(α-Me-2,6-F-Phe)-Nle-HQ-(α-Me-2,6-F-Phe)-A-Arg(NO$_2$)-(α-Me—2F-Phe) |
| 526 | Aib-V-Aib-EIQ-(α-Me-2,6-F-Phe)-Nle-HQ-(α-Me-2,6-F-Phe)-Aib-Arg(NO$_2$)-(α-Me—2F-Phe) |
| 527 | (AC$_5$C)-V-Aib-EIQ-(α-Me-2,6-F-Phe)-Nle-HQ-(α-Me-2,6-F-Phe)-A-Arg(NO$_2$)-(α-Me—2F-Phe) |
| 528 | (AC$_5$C)-V-Aib-EIQ-(α-Me-2,6-F-Phe)-Nle-HQ-(α-Me-2,6-F-Phe)-Aib-Arg(NO$_2$)-(α-Me—2F-Phe) |
| 529 | Aib-V-Aib-EIQ-(α-Me—2F-Phe)-Nle-HQ-(α-Me-2,6-F-Phe)-A-Arg(NO$_2$)-(α-Me-2,6-F-Phe) |
| 530 | Aib-V-Aib-EIQ-(α-Me—2F-Phe)-Nle-HQ-(α-Me-2,6-F-Phe)-Aib-Arg(NO$_2$)-(α-Me-2,6-F-Phe) |
| 531 | (AC$_5$C)-V-Aib-EIQ-(α-Me—2F-Phe)-Nle-HQ-(α-Me-2,6-F-Phe)-A-Arg(NO$_2$)-(α-Me-2,6-F-Phe) |
| 532 | (AC$_5$C)-V-Aib-EIQ-(α-Me—2F-Phe)-Nle-HQ-(α-Me-2,6-F-Phe)-Aib-Arg(NO$_2$)-(α-Me-2,6-F-Phe) |
| 533 | Aib-V-Aib-EIQ-(α-Me-2,6-F-Phe)-Nle-HQ-(α-Me-2,6-F-Phe)-A-Arg(NO$_2$)-(α-Me-2,6-F-Phe) |
| 534 | Aib-V-Aib-EIQ-(α-Me-2,6-F-Phe)-Nle-HQ-(α-Me-2,6-F-Phe)-Aib-Arg(NO$_2$)-(α-Me-2,6-F-Phe) |
| 535 | (AC$_5$C)-V-Aib-EIQ-(α-Me-2,6-F-Phe)-Nle-HQ-(α-Me-2,6-F-Phe)-A-Arg(NO$_2$)-(α-Me-2,6-F-Phe) |
| 536 | (AC$_5$C)-V-Aib-EIQ-(α-Me-2,6-F-Phe)-Nle-HQ-(α-Me-2,6-F-Phe)-Aib-Arg(NO$_2$)-(α-Me-2,6-F-Phe) |

TABLE 2 (xiii)

List of short-chain peptides prepared

| Seq. ID. No. | Sequence of short-chain peptides |
|---|---|
| 537 | Aib-V-Aib-EIQ-(α-Me—2F-Phe)-Nle-HQ-Aib-A-Cit-(α-Me—2F-Phe) |
| 538 | Aib-V-Aib-EIQ-(α-Me—2F-Phe)-Nle-HQ-Aib-Aib-Cit-(α-Me—2F-Phe) |
| 539 | (AC$_5$C)-V-Aib-EIQ-(α-Me—2F-Phe)-Nle-HQ-Aib-A-Cit-(α-Me—2F-Phe) |
| 540 | (AC$_5$C)-V-Aib-EIQ-(α-Me—2F-Phe)-Nle-HQ-Aib-Aib-Cit-(α-Me—2F-Phe) |
| 541 | Aib-V-Aib-EIQ-(α-Me-2,6-F-Phe)-Nle-HQ-Aib-A-Cit-(α-Me—2F-Phe) |
| 542 | Aib-V-Aib-EIQ-(α-Me-2,6-F-Phe)-Nle-HQ-Aib-Aib-Cit-(α-Me—2F-Phe) |
| 543 | (AC$_5$C)-V-Aib-EIQ-(α-Me-2,6-F-Phe)-Nle-HQ-Aib-A-Cit-(α-Me—2F-Phe) |
| 544 | (AC$_5$C)-V-Aib-EIQ-(α-Me-2,6-F-Phe)-Nle-HQ-Aib-Aib-Cit-(α-Me—2F-Phe) |
| 545 | Aib-V-Aib-EIQ-(α-Me—2F-Phe)-Nle-HQ-Aib-A-Cit-(α-Me-2,6-F-Phe) |
| 546 | Aib-V-Aib-EIQ-(α-Me—2F-Phe)-Nle-HQ-Aib-Aib-Cit-(α-Me-2,6-F-Phe) |
| 547 | (AC$_5$C)-V-Aib-EIQ-(α-Me—2F-Phe)-Nle-HQ-Aib-A-Cit-(α-Me-2,6-F-Phe) |
| 548 | (AC$_5$C)-V-Aib-EIQ-(α-Me—2F-Phe)-Nle-HQ-Aib-Aib-Cit-(α-Me-2,6-F-Phe) |

TABLE 2 (xiii)-continued

List of short-chain peptides prepared

| Seq. ID. No. | Sequence of short-chain peptides |
|---|---|
| 549 | Aib-V-Aib-EIQ-(α-Me-2,6-F-Phe)-Nle-HQ-Aib-A-Cit-(α-Me-2,6-F-Phe) |
| 550 | Aib-V-Aib-EIQ-(α-Me-2,6-F-Phe)-Nle-HQ-Aib-Aib-Cit-(α-Me-2,6-F-Phe) |
| 551 | (AC₅C)-V-Aib-EIQ-(α-Me-2,6-F-Phe)-Nle-HQ-Aib-A-Cit-(α-Me-2,6-F-Phe) |
| 552 | (AC₅C)-V-Aib-EIQ-(α-Me-2,6-F-Phe)-Nle-HQ-Aib-Aib-Cit-(α-Me-2,6-F-Phe) |
| 553 | Aib-V-Aib-EIQ-(α-Me—2F-Phe)-Nle-HQ-Aib-A-Aib-(α-Me—2F-Phe) |
| 554 | Aib-V-Aib-EIQ-(α-Me—2F-Phe)-Nle-HQ-Aib-Aib-Aib-(α-Me—2F-Phe) |
| 555 | (AC₅C)-V-Aib-EIQ-(α-Me—2F-Phe)-Nle-HQ-Aib-A-Aib-(α-Me—2F-Phe) |
| 556 | (AC₅C)-V-Aib-EIQ-(α-Me—2F-Phe)-Nle-HQ-Aib-Aib-Aib-(α-Me—2F-Phe) |
| 557 | Aib-V-Aib-EIQ-(α-Me-2,6-F-Phe)-Nle-HQ-Aib-A-Aib-(α-Me—2F-Phe) |
| 558 | Aib-V-Aib-EIQ-(α-Me-2,6-F-Phe)-Nle-HQ-Aib-Aib-Aib-(α-Me—2F-Phe) |
| 559 | (AC₅C)-V-Aib-EIQ-(α-Me-2,6-F-Phe)-Nle-HQ-Aib-A-Aib-(α-Me—2F-Phe) |
| 560 | (AC₅C)-V-Aib-EIQ-(α-Me-2,6-F-Phe)-Nle-HQ-Aib-Aib-Aib-(α-Me—2F-Phe) |
| 561 | Aib-V-Aib-EIQ-(α-Me—2F-Phe)-Nle-HQ-Aib-A-Aib-(α-Me-2,6-F-Phe) |
| 562 | Aib-V-Aib-EIQ-(α-Me—2F-Phe)-Nle-HQ-Aib-Aib-Aib-(α-Me-2,6-F-Phe) |
| 563 | (AC₅C)-V-Aib-EIQ-(α-Me—2F-Phe)-Nle-HQ-Aib-A-Aib-(α-Me-2,6-F-Phe) |
| 564 | (AC₅C)-V-Aib-EIQ-(α-Me—2F-Phe)-Nle-HQ-Aib-Aib-Aib-(α-Me-2,6-F-Phe) |
| 565 | Aib-V-Aib-EIQ-(α-Me-2,6-F-Phe)-Nle-HQ-Aib-A-Aib-(α-Me-2,6-F-Phe) |
| 566 | Aib-V-Aib-EIQ-(α-Me-2,6-F-Phe)-Nle-HQ-Aib-Aib-Aib-(α-Me-2,6-F-Phe) |
| 567 | (AC₅C)-V-Aib-EIQ-(α-Me-2,6-F-Phe)-Nle-HQ-Aib-A-Aib-(α-Me-2,6-F-Phe) |
| 568 | (AC₅C)-V-Aib-EIQ-(α-Me-2,6-F-Phe)-Nle-HQ-Aib-Aib-Aib-(α-Me-2,6-F-Phe) |
| 569 | Aib-V-Aib-EIQ-(α-Me—2F-Phe)-Nle-HQ-Aib-A-(α-Me-2,6-F-Phe)-(α-Me—2F-Phe) |
| 570 | Aib-V-Aib-EIQ-(α-Me—2F-Phe)-Nle-HQ-Aib-Aib-(α-Me-2,6-F-Phe)-(α-Me-2F-Phe) |
| 571 | (AC₅C)-V-Aib-EIQ-(α-Me—2F-Phe)-Nle-HQ-Aib-A-(α-Me-2,6-F-Phe)-(α-Me-2F-Phe) |
| 572 | (AC₅C)-V-Aib-EIQ-(α-Me—2F-Phe)-Nle-HQ-Aib-Aib-(α-Me-2,6-F-Phe)-(α-Me—2F-Phe) |
| 573 | Aib-V-Aib-EIQ-(α-Me-2,6-F-Phe)-Nle-HQ-Aib-A-(α-Me-2,6-F-Phe)-(α-Me-2F-Phe) |
| 574 | Aib-V-Aib-EIQ-(α-Me-2,6-F-Phe)-Nle-HQ-Aib-Aib-(α-Me-2,6-F-Phe)-(α-Me—2F-Phe) |
| 575 | (AC₅C)-V-Aib-EIQ-(α-Me-2,6-F-Phe)-Nle-HQ-Aib-A-(α-Me-2,6-F-Phe)-(α-Me—2F-Phe) |
| 576 | (AC₅C)-V-Aib-EIQ-(α-Me-2,6-F-Phe)-Nle-HQ-Aib-Aib-(α-Me-2,6-F-Phe)-(α-Me—2F-Phe) |
| 577 | Aib-V-Aib-EIQ-(α-Me—2F-Phe)-Nle-HQ-Aib-A-(α-Me-2,6-F-Phe)-(α-Me-2,6-F-Phe) |
| 578 | Aib-V-Aib-EIQ-(α-Me—2F-Phe)-Nle-HQ-Aib-Aib-(α-Me-2,6-F-Phe)-(α-Me-2,6-F-Phe) |
| 579 | (AC₅C)-V-Aib-EIQ-(α-Me—2F-Phe)-Nle-HQ-Aib-A-(α-Me-2,6-F-Phe)-(α-Me-2,6-F-Phe) |

TABLE 2 (xiii)-continued

List of short-chain peptides prepared

| Seq. ID. No. | Sequence of short-chain peptides |
|---|---|
| 580 | (AC₅C)-V-Aib-EIQ-(α-Me—2F-Phe)-Nle-HQ-Aib-Aib-(α-Me-2,6-F-Phe)-(α-Me-2,6-F-Phe) |
| 581 | Aib-V-Aib-EIQ-(α-Me-2,6-F-Phe)-Nle-HQ-Aib-A-(α-Me-2,6-F-Phe)-(α-Me-2,6-F-Phe) |
| 582 | Aib-V-Aib-EIQ-(α-Me-2,6-F-Phe)-Nle-HQ-Aib-Aib-(α-Me-2,6-F-Phe)-(α-Me-2,6-F-Phe) |
| 583 | (AC₅C)-V-Aib-EIQ-(α-Me-2,6-F-Phe)-Nle-HQ-Aib-A-(α-Me-2,6-F-Phe)-(α-Me-2,6-F-Phe) |
| 584 | (AC₅C)-V-Aib-EIQ-(α-Me-2,6-F-Phe)-Nle-HQ-Aib-Aib-(α-Me-2,6-F-Phe)-(α-Me-2,6-F-Phe) |
| 585 | Aib-V-Aib-EIQ-(α-Me—2F-Phe)-Nle-HQ-Aib-A-Arg(NO₂)-(α-Me—2F-Phe) |
| 586 | Aib-V-Aib-EIQ-(α-Me—2F-Phe)-Nle-HQ-Aib-Aib-Arg(NO₂)-(α-Me—2F-Phe) |
| 587 | (AC₅C)-V-Aib-EIQ-(α-Me—2F-Phe)-Nle-HQ-Aib-A-Arg(NO₂)-(α-Me—2F-Phe) |
| 588 | (AC₅C)-V-Aib-EIQ-(α-Me—2F-Phe)-Nle-HQ-Aib-Aib-Arg(NO₂)-(α-Me—2F-Phe) |
| 589 | Aib-V-Aib-EIQ-(α-Me-2,6-F-Phe)-Nle-HQ-Aib-A-Arg(NO₂)-(α-Me—2F-Phe) |
| 590 | Aib-V-Aib-EIQ-(α-Me-2,6-F-Phe)-Nle-HQ-Aib-Aib-Arg(NO₂)-(α-Me—2F-Phe) |
| 591 | (AC₅C)-V-Aib-EIQ-(α-Me-2,6-F-Phe)-Nle-HQ-Aib-A-Arg(NO₂)-(α-Me—2F-Phe) |
| 592 | (AC₅C)-V-Aib-EIQ-(α-Me-2,6-F-Phe)-Nle-HQ-Aib-Aib-Arg(NO₂)-(α-Me—2F-Phe) |
| 593 | Aib-V-Aib-EIQ-(α-Me—2F-Phe)-Nle-HQ-Aib-A-Arg(NO₂)-(α-Me-2,6-F-Phe) |
| 594 | Aib-V-Aib-EIQ-(α-Me—2F-Phe)-Nle-HQ-Aib-Aib-Arg(NO₂)-(α-Me-2,6-F-Phe) |
| 595 | (AC₅C)-V-Aib-EIQ-(α-Me—2F-Phe)-Nle-HQ-Aib-A-Arg(NO₂)-(α-Me-2,6-F-Phe) |
| 596 | (AC₅C)-V-Aib-EIQ-(α-Me—2F-Phe)-Nle-HQ-Aib-Aib-Arg(NO₂)-(α-Me-2,6-F-Phe) |
| 597 | Aib-V-Aib-EIQ-(α-Me-2,6-F-Phe)-Nle-HQ-Aib-A-Arg(NO₂)-(α-Me-2,6-F-Phe) |
| 598 | Aib-V-Aib-EIQ-(α-Me-2,6-F-Phe)-Nle-HQ-Aib-Aib-Arg(NO₂)-(α-Me-2,6-F-Phe) |
| 599 | (AC₅C)-V-Aib-EIQ-(α-Me-2,6-F-Phe)-Nle-HQ-Aib-A-Arg(NO₂)-(α-Me-2,6-F-Phe) |
| 600 | (AC₅C)-V-Aib-EIQ-(α-Me-2,6-F-Phe)-Nle-HQ-Aib-Aib-Arg(NO₂)-(α-Me-2,6-F-Phe) |

TABLE 2 (xiv)

List of short-chain peptides prepared

| Seq. ID. No. | Sequence of short-chain peptides |
|---|---|
| 601 | Aib-V-Aib-EIQLMHQ-Har-AK-(Bip(OMe))-(APPA) |
| 602 | Aib-V-Aib-EIQL-Nle-HQ-Har-AK-(Bip(OMe))-(APPA) |
| 603 | (AC₃C)-V-Aib-EIQLMHQ-Har-AK-(Bip(OMe))-(APPA) |
| 604 | (AC₃C)-V-Aib-EIQL-Nle-HQ-Har-AK-(Bip(OMe))-(APPA) |
| 605 | (AC₅C)-V-Aib-EIQLMHQ-Har-AK-(Bip(OMe))-(APPA) |

TABLE 2 (xiv)-continued

List of short-chain peptides prepared

| Seq. ID. No. | Sequence of short-chain peptides |
|---|---|
| 606 | $(AC_5C)$-V-Aib-EIQL-Nle-HQ-Har-AK-(Bip(OMe))-(APPA) |
| 607 | Aib-V-$(AC_3C)$-EIQLMHQ-Har-AK-(Bip(OMe))-(APPA) |
| 608 | Aib-V-$(AC_3C)$-EIQL-Nle-HQ-Har-AK-(Bip(OMe))-(APPA) |
| 609 | $(AC_3C)$-V-$(AC_3C)$-EIQLMHQ-Har-AK-(Bip(OMe))-(APPA) |
| 610 | $(AC_3C)$-V-$(AC_3C)$-EIQL-Nle-HQ-Har-AK-(Bip(OMe))-(APPA) |
| 611 | $(AC_5C)$-V-$(AC_3C)$-EIQLMHQ-Har-AK-(Bip(OMe))-(APPA) |
| 612 | $(AC_5C)$-V-$(AC_3C)$-EIQL-Nle-HQ-Har-AK-(Bip(OMe))-(APPA) |
| 613 | Aib-V-Aib-EIQLMHQ-Har($NO_2$)-AK-(Bip(OMe))-(APPA) |
| 614 | Aib-V-Aib-EIQL-Nle-HQ-Har($NO_2$)-AK-(BiP(OMe))-(APPA) |
| 615 | $(AC_3C)$-V-Aib-EIQLMHQ-Har($NO_2$)-AK-(Bip(OMe))-(APPA) |
| 616 | $(AC_3C)$-V-Aib-EIQL-Nle-HQ-Har($NO_2$)-AK-(Bip(OMe))-(APPA) |
| 617 | $(AC_5C)$-V-Aib-EIQLMHQ-Har($NO_2$)-AK-(Bip(OMe))-(APPA) |
| 618 | $(AC_5C)$-V-Aib-EIQL-Nle-HQ-Har($NO_2$)-AK-(Bip(OMe))-(APPA) |
| 619 | Aib-V-$(AC_3C)$-EIQLMHQ-Har($NO_2$)-AK-(Bip(OMe))-(APPA) |
| 620 | Aib-V-$(AC_3C)$-EIQL-Nle-HQ-Har($NO_2$)-AK-(Bip(OMe))-(APPA) |
| 621 | $(AC_3C)$-V-$(AC_3C)$-EIQLMHQ-Har($NO_2$)-AK-(Bip(OMe))-(APPA) |
| 622 | $(AC_3C)$-V-$(AC_3C)$-EIQL-Nle-HQ-Har($NO_2$)-AK-(Bip(OMe))-(APPA) |
| 623 | $(AC_5C)$-V-$(AC_3C)$-EIQLMHQ-Har($NO_2$)-AK-(Bip(OMe))-(APPA) |
| 624 | $(AC_5C)$-V-$(AC_3C)$-EIQL-Nle-HQ-Har($NO_2$)-AK-(Bip(OMe))-(APPA) |
| 625 | Aib-V-Aib-EIQLMHQ-Har($NO_2$)-A-K(Biotin)-(Bip(OMe))-(APPA) |
| 626 | Aib-V-Aib-EIQL-Nle-HQ-Har($NO_2$)-A-K(Biotin)-(Bip(OMe))-(APPA) |
| 627 | Aib-V-Aib-EIQLMHQ-Har-A-K(Biotin)-(Bip(OMe))-(APPA) |
| 628 | Aib-V-Aib-EIQL-Nle-HQ-Har-A-K(Biotin)-(Bip(OMe))-(APPA) |
| 629 | Aib-V-Aib-EIQLMHQ-Har($NO_2$)-A-K(—CO—$(CH_2)_6$—$CH_3$)-(Bip(OMe))-(APPA) |
| 630 | Aib-V-Aib-EIQL-Nle-HQ-Har($NO_2$)-A-K(—CO—$(CH_2)_6$—$CH_3$)-(Bip(OMe))-(APPA) |
| 631 | Aib-V-Aib-EIQLMHQ-Har-A-K(—CO—$(CH_2)_6$—$CH_3$)-(BiP(OMe))-(APPA) |
| 632 | Aib-V-Aib-EIQL-Nle-HQ-Har-A-K(—CO—$(CH_2)_6$—$CH_3$)-(Bip(OMe))-(APPA) |
| 633 | Aib-V-Aib-EIQLMHQ-Har($NO_2$)-A-K(—CO—$(CH_2)_8$—$CH_3$)-(Bip(OMe))-(APPA) |
| 634 | Aib-V-Aib-EIQL-Nle-HQ-Har($NO_2$)-A-K(—CO—$(CH_2)_8$—$CH_3$)-(Bip(OMe))-(APPA) |
| 635 | Aib-V-Aib-EIQLMHQ-Har-A-K(—CO—$(CH_2)_8$—$CH_3$)-(Bip(OMe))-(APPA) |
| 636 | Aib-V-Aib-EIQL-Nle-HQ-Har-A-K(—CO—$(CH_2)_8$—$CH_3$)-(Bip(OMe))-(APPA) |
| 637 | $(AC_5C)$-V-$(AC_3C)$-EIQL-Nle-HQ-Har-A-K(—CO—$(CH_2)_8$—$CH_3$)-(BiP(OMe))-(APPA) |
| 638 | $(AC_5C)$-V-$(AC_3C)$-EIQLMEQ-Har($NO_2$)-A-(NMe)K-(Bip(OMe))-(APPA) |
| 639 | $(AC_5C)$-V-$(AC_3C)$-EIQL-Nle-HQ-Har($NO_2$)-A-(NMe)K-(Bip(OMe))-(APPA) |

TABLE 2 (xv)

List of short-chain peptides prepared

| Seq. ID. No. | Sequence of short-chain peptides |
|---|---|
| 640 | (AC$_5$C)-V-(AC$_3$C)-EIQL-(NMe)M-HQ-Har-A-K(—CO—(CH$_2$)$_8$—CH$_3$)-(Bip(OMe))-(APPA) |
| 641 | (AC$_5$C)-V-(AC$_3$C)-EIQL-(NMe)Nle-HQ-Har-A-K(—CO—(CH$_2$)$_8$—CH$_3$)-(Bip(OMe))-(APPA) |
| 642 | (AC$_3$C)-V-(AC$_3$C)-EIQL-(NMe)M-HQ-Har(NO$_2$)-A-(NMe)K-(Bip(OMe))-(APPA) |
| 643 | (AC$_3$C)-V-(AC$_3$C)-EIQL-(NMe)Nle-HQ-Har(NO$_2$)-A-(NMe)K-(Bip(OMe))-(APPA) |
| 644 | (AC$_5$C)-V-(AC$_3$C)-EIQL-(NMe)M-HQ-Har(NO$_2$)-A-(NMe)K-(Bip(OMe))-(APPA) |
| 645 | (AC$_5$C)-V-(AC$_3$C)-EIQL-(NMe)Nle-HQ-Har(NO$_2$)-A-(NMe)K-(Bip(OMe))-(APPA) |
| 646 | Aib-V-Aib-EIQLMHQ-Har-AK-(Bip(OMe)) |
| 647 | Aib-V-Aib-EIQL-Nle-HQ-Har-AK-(Bip(OMe)) |
| 648 | (AC$_3$C)-V-Aib-EIQLMHQ-Har-AK-(Bip(OMe)) |
| 649 | (AC$_3$C)-V-Aib-EIQL-Nle-HQ-Har-AK-(Bip(OMe)) |
| 650 | (AC$_5$C)-V-Aib-EIQLMHQ-Har-AK-(Bip(OMe)) |
| 651 | (AC$_5$C)-V-Aib-EIQL-Nle-HQ-Har-AK-(Bip(OMe)) |
| 652 | Aib-V-(AC$_3$C)-EIQLMHQ-Har-AK-(Bip(OMe)) |
| 653 | Aib-V-(AC$_3$C)-EIQL-Nle-HQ-Har-AK-(Bip(OMe)) |
| 654 | (AC$_3$C)-V-(AC$_3$C)-EIQLMHQ-Har-AK-(Bip(OMe)) |
| 655 | (AC$_3$C)-V-(AC$_3$C)-EIQL-Nle-HQ-Har-AK-(Bip(OMe)) |
| 656 | (AC$_5$C)-V-(AC$_3$C)-EIQLMHQ-Har-AK-(Bip(OMe)) |
| 657 | (AC$_5$C)-V-(AC$_3$C)-EIQL-Nle-HQ-Har-AK-(Bip(OMe)) |
| 658 | Aib-V-Aib-EIQLMHQ-Har(NO$_2$)-AK-(Bip(OMe)) |
| 659 | Aib-V-Aib-EIQL-Nle-HQ-Har(NO$_2$)-AK-(Bip(OMe)) |
| 660 | Aib-V-Aib-EIQLMHQ-Har(NO$_2$)-A-K(Biotin)-(Bip(OMe)) |
| 661 | Aib-V-Aib-EIQL-Nle-HQ-Har(NO$_2$)-A-K(Biotin)-(Bip(OMe)) |
| 662 | Aib-V-Aib-EIQLMHQ-Har-A-K(Biotin)-(Bip(OMe)) |
| 663 | Aib-V-Aib-EIQL-Nle-HQ-Har-A-K(Biotin)-(Bip(OMe)) |
| 664 | Aib-V-Aib-EIQLMHQ-Har(NO$_2$)-A-K(—CO—(CH$_2$)$_6$—CH$_3$)-(Bip(OMe)) |
| 665 | Aib-V-Aib-EIQL-Nle-HQ-Har(NO$_2$)-A-K(—CO—(CH$_2$)$_6$—CH$_3$)-(Bip(OMe)) |
| 666 | Aib-V-Aib-EIQLMHQ-Har-A-K(—CO—(CH$_2$)$_6$—CH$_3$)-(Bip(OMe)) |
| 667 | Aib-V-Aib-EIQL-Nle-HQ-Har-A-K(—CO—(CH$_2$)$_6$—CH$_3$)-(Bip(OMe)) |
| 668 | Aib-V-Aib-EIQLMHQ-Har(NO$_2$)-A-K(—CO—(CH$_2$)$_8$—CH$_3$)-(Bip(OMe)) |
| 669 | Aib-V-Aib-EIQL-Nle-HQ-Har(NO$_2$)-A-K(—CO—(CH$_2$)$_8$—CH$_3$)-(Bip(OMe)) |
| 670 | Aib-V-Aib-EIQLMHQ-Har-A-K(—CO—(CH$_2$)$_8$—CH$_3$)-(Bip(OMe)) |
| 671 | Aib-V-Aib-EIQL-Nle-HQ-Har-A-K(—CO—(CH$_2$)$_8$—CH$_3$)-(Bip(OMe)) |
| 672 | (AC$_5$C)-V-(AC$_3$C)-EIQLMHQ-Har-A-K(—CO—(CH$_2$)$_8$—CH$_3$)-(Bip(OMe)) |

TABLE 2 (xv)-continued

List of short-chain peptides prepared

| Seq. ID. No. | Sequence of short-chain peptides |
|---|---|
| 673 | $(AC_5C)$-V-$(AC_3C)$-EIQL-Nle-HQ-Har-A-K(—CO—$(CH_2)_8$—$CH_3$)-(Bip(OMe)) |
| 674 | $(AC_5C)$-V-$(AC_3C)$-EIQLMHQ-Har$(NO_2)$-A-(NMe)K-(Bip(OMe)) |
| 675 | $(AC_5C)$-V-$(AC_3C)$-EIQL-Nle-HQ-Har$(NO_2)$-A-(NMe)K-(Bip(OMe)) |

TABLE 2 (xvi)

List of short-chain peptides prepared

| Seq. ID. No. | Sequence of short-chain peptides |
|---|---|
| 676 | Aib-V-Aib-EIQL-(NMe)M-HQ-Har-A-K(—CO—$(CH_2)_8$—$CH_3$)-(Bip(OMe)) |
| 677 | Aib-V-Aib-EIQL-(NMe)Nle-HQ-Har-A-K(—CO—$(CH_2)_8$—$CH_3$)-(Bip(OMe)) |
| 678 | $(AC_3C)$-V-Aib-EIQL-(NMe)M-HQ-Har-A-K(—CO—$(CH_2)_8$—$CH_3$)-(Bip(OMe)) |
| 679 | $(AC_3C)$-V-Aib-EIQL-(NMe)Nle-HQ-Har-A-K(—CO—$(CH_2)_8$—$CH_3$)-(Bip(OMe)) |
| 680 | Aib-V-Aib-EIQLMHQ-Har-A-Arg$(NO_2)$-(Bip(OMe))-(APPA) |
| 681 | Aib-V-Aib-EIQL-Nle-HQ-Har-A-Arg$(NO_2)$-(Bip(OMe))-(APPA) |
| 682 | $(AC_3C)$-V-Aib-EIQLMHQ-Har-A-Arg$(NO_2)$-(Bip(OMe))-(APPA) |
| 683 | $(AC_3C)$-V-Aib-EIQL-Nle-HQ-Har-A-Arg$(NO_2)$-(Bip(OMe))-(APPA) |
| 684 | $(AC_5C)$-V-Aib-EIQLMHQ-Har-A-Arg$(NO_2)$-(Bip(OMe))-(APPA) |
| 685 | $(AC_5C)$-V-Aib-EIQLMHQ-Har-Aib-Arg$(NO_2)$-(Bip(OMe))-(APPA) |
| 686 | $(AC_5C)$-V-Aib-EIQL-Nle-HQ-Har-A-Arg$(NO_2)$-(Bip(OMe))-(APPA) |
| 687 | Aib-V-$(AC_3C)$-EIQLMHQ-Har-A-Arg$(NO_2)$-(Bip(OMe))-(APPA) |
| 688 | Aib-V-$(AC_3C)$-EIQL-Nle-HQ-Har-A-Arg$(NO_2)$-(Bip(OMe))-(APPA) |
| 689 | $(AC_3C)$-V-$(AC_3C)$-EIQLMHQ-Har-A-Arg$(NO_2)$-(Bip(OMe))-(APPA) |
| 690 | $(AC_3C)$-V-$(AC_3C)$-EIQL-Nle-HQ-Har-A-Arg$(NO_2)$-(Bip(OMe))-(APPA) |
| 691 | $(AC_5C)$-V-$(AC_3C)$-EIQLMHQ-Har-A-Arg$(NO_2)$-(Bip(OMe))-(APPA) |
| 692 | $(AC_5C)$-V-$(AC_3C)$-EIQL-Nle-HQ-Har-A-Arg$(NO_2)$-(Bip(OMe))-(APPA) |
| 693 | Aib-V-Aib-EIQ-($\alpha$-Me-2,6-F-Phe)-Nle-HQ-Har-A-Arg$(NO_2)$-(Bip(OMe))-(APPA) |
| 694 | $(AC_3C)$-V-Aib-EIQ-($\alpha$-Me-2,6-F-Phe)-Nle-HQ-Har-A-Arg$(NO_2)$-(Bip(OMe))-(APPA) |
| 695 | $(AC_5C)$-V-Aib-EIQ-($\alpha$-Me-2,6-F-Phe)-Nle-HQ-Har-A-Arg$(NO_2)$-(Bip(OMe))-(APPA) |
| 696 | Aib-V-$(AC_3C)$-EIQ-($\alpha$-Me-2,6-F-Phe)-Nle-HQ-Har-A-Arg$(NO_2)$-(Bip(OMe))-(APPA) |
| 697 | $(AC_3C)$-V-$(AC_3C)$-EIQ-($\alpha$-Me-2,6-F-Phe)-Nle-HQ-Har-A-Arg$(NO_2)$-(Bip(OMe))-(APPA) |
| 698 | $(AC_5C)$-V-$(AC_3C)$-EIQ-($\alpha$-Me-2,6-F-Phe)-Nle-HQ-Har-A-Arg$(NO_2)$-(Bip(OMe))-(APPA) |
| 699 | Aib-V-Aib-EIQ-($\alpha$-Me—2F-Phe)-Nle-HQ-Har-A-Arg$(NO_2)$-(Bip(OMe))-(APPA) |
| 700 | $(AC_3C)$-V-Aib-EIQ-($\alpha$-Me—2F-Phe)-Nle-HQ-Har-A-Arg$(NO_2)$-(Bip(OMe))-(APPA) |

TABLE 2 (xvi)-continued

List of short-chain peptides prepared

| Seq. ID. No. | Sequence of short-chain peptides |
|---|---|
| 701 | (AC₅C)-V-Aib-EIQ-(α-Me-2F-Phe)-Nle-HQ-Har-A-Arg(NO₂)-(Bip(OMe))-(APPA) |
| 702 | Aib-V-(AC₃C)-EIQ-(α-Me-2F-Phe)-Nle-HQ-Har-A-Arg(NO₂)-(Bip(OMe))-(APPA) |
| 703 | (AC₃C)-V-(AC₃C)-EIQ-(α-Me-2F-Phe)-Nle-HQ-Har-A-Arg(NO₂)-(Bip(OMe))-(APPA) |
| 704 | (AC₅C)-V-(AC₃C)-EIQ-(α-Me-2F-Phe)-Nle-HQ-Har-A-Arg(NO₂)-(Bip(OMe))-(APPA) |
| 705 | Aib-V-Aib-EIQ-(α-Me-2,6-F-Phe)-Nle-HQ-Har-A-Arg(NO₂)-(α-Me-2,6-F-Phe)-(APPA) |
| 706 | (AC₃C)-V-Aib-EIQ-(α-Me-2,6-F-Phe)-Nle-HQ-Har-A-Arg(NO₂)-(α-Me-2,6-F-Phe)-(APPA) |
| 707 | (AC₅C)-V-Aib-EIQ-(α-Me-2,6-F-Phe)-Nle-HQ-Har-A-Arg(NO₂)-(α-Me-2,6-F-Phe)-(APPA) |
| 708 | Aib-V-(AC₃C)-EIQ-(α-Me-2,6-F-Phe)-Nle-HQ-Har-A-Arg(NO₂)-(α-Me-2,6-F-Phe)-(APPA) |
| 709 | (AC₃C)-V-(AC₃C)-EIQ-(α-Me-2,6-F-Phe)-Nle-HQ-Har-A-Arg(NO₂)-(α-Me-2,6-F-Phe)-(APPA) |
| 710 | (AC₅C)-V-(AC₃C)-EIQ-(α-Me-2,6-F-Phe)-Nle-HQ-Har-A-Arg(NO₂)-(α-Me-2,6-F-Phe)-(APPA) |
| 711 | Aib-V-Aib-EIQ-(α-Me-2F-Phe)-Nle-HQ-Har-A-Arg(NO₂)-(α-Me-2,6-F-Phe)-(APPA) |
| 712 | (AC₃C)-V-Aib-EIQ-(α-Me-2F-Phe)-Nle-HQ-Har-A-Arg(NO₂)-(α-Me-2,6-F-Phe)-(APPA) |
| 713 | (AC₅C)-V-Aib-EIQ-(α-Me-2F-Phe)-Nle-HQ-Har-A-Arg(NO₂)-(α-Me-2,6-F-Phe)-(APPA) |
| 714 | Aib-V-(AC₃C)-EIQ-(α-Me-2F-Phe)-Nle-HQ-Har-A-Arg(NO₂)-(α-Me-2,6-F-Phe)-(APPA) |
| 715 | (AC₃C)-V-(AC₃C)-EIQ-(α-Me-2F-Phe)-Nle-HQ-Har-A-Arg(NO₂)-(α-Me-2,6-F-Phe)-(APPA) |
| 716 | (AC₅C)-V-(AC₃C)-EIQ-(α-Me-2F-Phe)-Nle-HQ-Har-A-Arg(NO₂)-(α-Me-2,6-F-Phe)-(APPA) |
| 717 | Aib-V-Aib-EIQ-(α-Me-2,6-F-Phe)-Nle-HQ-Har-A-Arg(NO₂)-(α-Me-2F-Phe)-(APPA) |
| 718 | (AC₃C)-V-Aib-EIQ-(α-Me-2,6-F-Phe)-Nle-HQ-Har-A-Arg(NO₂)-(α-Me-2F-Phe)-(APPA) |
| 719 | (AC₅C)-V-Aib-EIQ-(α-Me-2,6-F-Phe)-Nle-HQ-Har-A-Arg(NO₂)-(α-Me-2F-Phe)-(APPA) |
| 720 | Aib-V-(AC₃C)-EIQ-(α-Me-2,6-F-Phe)-Nle-HQ-Har-A-Arg(NO₂)-(α-Me-2F-Phe)-(APPA) |
| 721 | (AC₃C)-V-(AC₃C)-EIQ-(α-Me-2,6-F-Phe)-Nle-HQ-Har-A-Arg(NO₂)-(α-Me-2F-Phe)-(APPA) |
| 722 | (AC₅C)-V-(AC₃C)-EIQ-(α-Me-2,6-F-Phe)-Nle-HQ-Har-A-Arg(NO₂)-(α-Me-2F-Phe)-(APPA) |
| 723 | Aib-V-Aib-EIQ-(α-Me-2F-Phe)-Nle-HQ-Har-A-Arg(NO₂)-(α-Me-2F-Phe)-(APPA) |
| 724 | (AC₃C)-V-Aib-EIQ-(α-Me-2F-Phe)-Nle-HQ-Har-A-Arg(NO₂)-(α-Me-2F-Phe)-(APPA) |
| 725 | (AC₅C)-V-Aib-EIQ-(α-Me-2F-Phe)-Nle-HQ-Har-A-Arg(NO₂)-(α-Me-2F-Phe)-(APPA) |

TABLE 2 (xvi)-continued

List of short-chain peptides prepared

| Seq. ID. No. | Sequence of short-chain peptides |
|---|---|
| 726 | (AC$_5$C)-V-Aib-EIQ-(α-Me—2F-Phe)-Nle-HQ-Har-Aib-Arg(NO$_2$)-(α-Me—2F-Phe)-(APPA) |
| 727 | Aib-V-(AC$_3$C)-EIQ-(α-Me—2F-Phe)-Nle-HQ-Har-A-Arg(NO$_2$)-(α-Me—2F-Phe)-(APPA) |
| 728 | (AC$_3$C)-V-(AC$_3$C)-EIQ-(α-Me—2F-Phe)-Nle-HQ-Har-A-Arg(NO$_2$)-(α-Me—2F-Phe)-(APPA) |
| 729 | (AC$_5$C)-V-(AC$_3$C)-EIQ-(α-Me—2F-Phe)-Nle-HQ-Har-A-Arg(NO$_2$)-(α-Me—2F-Phe)-(APPA) |

TABLE 2 (xvii)

List of short-chain peptides prepared

| Seq. ID. No. | Sequence of short-chain peptides |
|---|---|
| 730 | Aib-V-Aib-EIQL-Nle-HQ-Har-AR-(Bip(OMe))-(APPA) |
| 731 | (AC$_5$C)-V-Aib-EIQL-Nle-HQ-Har-AR-(Bip(OMe))-(APPA) |
| 732 | Aib-V-Aib-EIQL-Nle-HQ-Har-A-Cit-(Bip(OMe))-(APPA) |
| 733 | (AC$_5$C)-V-Aib-EIQL-Nle-HQ-Har-A-Cit-(Bip(OMe))-(APPA) |
| 734 | Aib-V-Aib-EIQL-Nle-HQ-Har-A-Aib-(Bip(OMe))-(APPA) |
| 735 | (AC$_5$C)-V-Aib-EIQL-Nle-HQ-Har-A-Aib-(Bip(OMe))-(APPA) |
| 736 | Aib-V-Aib-EIQL-Nle-HQ-Har-A-(α-Me-2,6-F-Phe)-(Bip(OMe))-(APPA) |
| 737 | (AC$_5$C)-V-Aib-EIQL-Nle-HQ-Har-A-(α-Me-2,6-F-Phe)-(Bip(OMe))-(APPA) |
| 738 | Aib-V-Aib-EIQL-Nle-HQ-Har-Aib-R-(Bip(OMe))-(APPA) |
| 739 | (AC$_5$C)-V-Aib-EIQL-Nle-HQ-Har-Aib-R-(Bip(OMe))-(APPA) |
| 740 | Aib-V-Aib-EIQL-Nle-HQ-Har-Aib-Cit-(Bip(OMe))-(APPA) |
| 741 | (AC$_5$C)-V-Aib-EIQL-Nle-HQ-Har-Aib-Cit-(Bip(OMe))-(APPA) |
| 742 | Aib-V-Aib-EIQL-Nle-HQ-Har-Aib-Aib-(Bip(OMe))-(APPA) |
| 743 | (AC$_5$C)-V-Aib-EIQL-Nle-HQ-Har-Aib-Aib-(Bip(OMe))-(APPA) |
| 744 | Aib-V-Aib-EIQL-Nle-HQ-Har-Aib-(α-Me-2,6-F-Phe)-(Bip(OMe))-(APPA) |
| 745 | (AC$_5$C)-V-Aib-EIQL-Nle-HQ-Har-Aib-(α-Me-2,6-F-Phe)-(Bip(OMe))-(APPA) |
| 746 | Aib-V-Aib-EIQL-Nle-HQ-Orn-AR-(Bip(OMe))-(APPA) |
| 747 | (AC$_5$C)-V-Aib-EIQL-Nle-HQ-Orn-AR-(Bip(OMe))-(APPA) |
| 748 | Aib-V-Aib-EIQL-Nle-HQ-Orn-A-Cit-(Bip(OMe))-(APPA) |
| 749 | (AC$_5$C)-V-Aib-EIQL-Nle-HQ-Orn-A-Cit-(Bip(OMe))-(APPA) |
| 750 | Aib-V-Aib-EIQL-Nle-HQ-Orn-A-Aib-(Bip(OMe))-(APPA) |
| 751 | (AC$_5$C)-V-Aib-EIQL-Nle-HQ-Orn-A-Aib-(Bip(OMe))-(APPA) |
| 752 | Aib-V-Aib-EIQL-Nle-HQ-Orn-A-(α-Me-2,6-F-Phe)-(Bip(OMe))-(APPA) |
| 753 | (AC$_5$C)-V-Aib-EIQL-Nle-HQ-Orn-A-(α-Me-2,6-F-Phe)-(Bip(OMe))-(APPA) |
| 754 | Aib-V-Aib-EIQL-Nle-HQ-Orn-Aib-R-(Bip(OMe))-(APPA) |

TABLE 2 (xvii)-continued

List of short-chain peptides prepared

| Seq. ID. No. | Sequence of short-chain peptides |
|---|---|
| 755 | (AC$_5$C)-V-Aib-EIQL-Nle-HQ-Orn-Aib-R-(Bip(OMe))-(APPA) |
| 756 | Aib-V-Aib-EIQL-Nle-HQ-Orn-Aib-Cit-(Bip(OMe))-(APPA) |
| 757 | (AC$_5$C)-V-Aib-EIQL-Nle-HQ-Orn-Aib-Cit-(Bip(OMe))-(APPA) |
| 758 | Aib-V-Aib-EIQL-Nle-HQ-Orn-Aib-Aib-(Bip(OMe))-(APPA) |
| 759 | (AC$_5$C)-V-Aib-EIQL-Nle-HQ-Orn-Aib-Aib-(Bip(OMe))-(APPA) |
| 760 | Aib-V-Aib-EIQL-Nle-HQ-Orn-Aib-(α-Me-2,6-F-Phe)-(Bip(OMe))-(APPA) |
| 761 | (AC$_5$C)-V-Aib-EIQL-Nle-HQ-Orn-Aib-(α-Me-2,6-F-Phe)-(Bip(OMe))-(APPA) |
| 762 | Aib-V-Aib-EIQL-Nle-HQ-Cit-AR-(Bip(OMe))-(APPA) |
| 763 | (AC$_5$C)-V-Aib-EIQL-Nle-HQ-Cit-AR-(Bip(OMe))-(APPA) |
| 764 | Aib-V-Aib-EIQL-Nle-HQ-Cit-A-Cit-(Bip(OMe))-(APPA) |
| 765 | (AC$_5$C)-V-Aib-EIQL-Nle-HQ-Cit-A-Cit-(Bip(OMe))-(APPA) |
| 766 | Aib-V-Aib-EIQL-Nle-HQ-Cit-A-Aib-(Bip(OMe))-(APPA) |
| 767 | (AC$_5$C)-V-Aib-EIQL-Nle-HQ-Cit-A-Aib-(Bip(OMe))-(APPA) |
| 768 | Aib-V-Aib-EIQL-Nle-HQ-Cit-A-(α-Me-2,6-F-Phe)-(Bip(OMe))-(APPA) |
| 769 | (AC$_5$C)-V-Aib-EIQL-Nle-HQ-Cit-A-(α-Me-2,6-F-Phe)-(Bip(OMe))-(APPA) |
| 770 | Aib-V-Aib-EIQL-Nle-HQ-Cit-Aib-R-(Bip(OMe))-(APPA) |
| 771 | (AC$_5$C)-V-Aib-EIQL-Nle-HQ-Cit-Aib-R-(Bip(OMe))-(APPA) |
| 772 | Aib-V-Aib-EIQL-Nle-HQ-Cit-Aib-Cit-(Bip(OMe))-(APPA) |
| 773 | (AC$_5$C)-V-Aib-EIQL-Nle-HQ-Cit-Aib-Cit-(Bip(OMe))-(APPA) |
| 774 | Aib-V-Aib-EIQL-Nle-HQ-Cit-Aib-Aib-(Bip(OMe))-(APPA) |
| 775 | (AC$_5$C)-V-Aib-EIQL-Nle-HQ-Cit-Aib-Aib-(Bip(OMe))-(APPA) |
| 776 | Aib-V-Aib-EIQL-Nle-HQ-Cit-Aib-(α-Me-2,6-F-Phe)-(Bip(OMe))-(APPA) |
| 777 | (AC$_5$C)-V-Aib-EIQL-Nle-HQ-Cit-Aib-(α-Me-2,6-F-Phe)-(Bip(OMe))-(APPA) |
| 778 | Aib-V-Aib-EIQL-Nle-HQ-(HoCit)-AR-(Bip(OMe))-(APPA) |
| 779 | (AC$_5$C)-V-Aib-EIQL-Nle-HQ-(HoCit)-AR-(Bip(OMe))-(APPA) |
| 780 | Aib-V-Aib-EIQL-Nle-HQ-(HoCit)-A-Cit-(Bip(OMe))-(APPA) |
| 781 | (AC$_5$C)-V-Aib-EIQL-Nle-HQ-(HoCit)-A-Cit-(Bip(OMe))-(APPA) |
| 782 | Aib-V-Aib-EIQL-Nle-HQ-(HoCit)-A-Aib-(Bip(OMe))-(APPA) |
| 783 | (AC$_5$C)-V-Aib-EIQL-Nle-HQ-(HoCit)-A-Aib-(Bip(OMe))-(APPA) |
| 784 | Aib-V-Aib-EIQL-Nle-HQ-(HoCit)-A-(α-Me-2,6-F-Phe)-(Bip(OMe))-(APPA) |
| 785 | (AC$_5$C)-V-Aib-EIQL-Nle-HQ-(HoCit)-A-(α-Me-2,6-F-Phe)-(Bip(OMe))-(APPA) |
| 786 | Aib-V-Aib-EIQL-Nle-HQ-(HoCit)-Aib-R-(Bip(OMe))-(APPA) |
| 787 | (AC$_5$C)-V-Aib-EIQL-Nle-HQ-(HoCit)-Aib-R-(Bip(OMe))-(APPA) |
| 788 | Aib-V-Aib-EIQL-Nle-HQ-(HoCit)-Aib-Cit-(Bip(OMe))-(APPA) |
| 789 | (AC$_5$C)-V-Aib-EIQL-Nle-HQ-(HoCit)-Aib-Cit-(Bip(OMe))-(APPA) |
| 790 | Aib-V-Aib-EIQL-Nle-HQ-(HoCit)-Aib-Aib-(Bip(OMe))-(APPA) |
| 791 | (AC$_5$C)-V-Aib-EIQL-Nle-HQ-(HoCit)-Aib-Aib-(Bip(OMe))-(APPA) |

TABLE 2 (xvii)-continued

List of short-chain peptides prepared

| Seq. ID. No. | Sequence of short-chain peptides |
|---|---|
| 792 | Aib-V-Aib-EIQL-Nle-HQ-(HoCit)-Aib-(α-Me-2,6-F-Phe)-(Bip(OMe))-(APPA) |
| 793 | (AC$_5$C)-V-Aib-EIQL-Nle-HQ-(HoCit)-Aib-(α-Me-2,6-F-Phe)-(Bip(OMe))-(APPA) |
| 794 | Aib-V-Aib-EIQL-Nle-HQ-(α-Me-2,6-F-Phe)-AR-(Bip(OMe))-(APPA) |
| 795 | (AC$_5$C)-V-Aib-EIQL-Nle-HQ-(α-Me-2,6-F-Phe)-AR-(Bip(OMe))-(APPA) |
| 796 | Aib-V-Aib-EIQL-Nle-HQ-(α-Me-2,6-F-Phe)-A-Cit-(Bip(OMe))-(APPA) |
| 797 | (AC$_5$C)-V-Aib-EIQL-Nle-HQ-(α-Me-2,6-F-Phe)-A-Cit-(Bip(OMe))-(APPA) |
| 798 | Aib-V-Aib-EIQL-Nle-HQ-(α-Me-2,6-F-Phe)-A-Aib-(Bip(OMe))-(APPA) |
| 799 | (AC$_5$C)-V-Aib-EIQL-Nle-HQ-(α-Me-2,6-F-Phe)-A-Aib-(Bip(OMe))-(APPA) |
| 800 | Aib-V-Aib-EIQL-Nle-HQ-(α-Me-2,6-F-Phe)-A-(α-Me-2,6-F-Phe)-(Bip(OMe))-(APPA) |
| 801 | (AC$_5$C)-V-Aib-EIQL-Nle-HQ-(α-Me-2,6-F-Phe)-A-(α-Me-2,6-F-Phe)-(Bip(OMe))-(APPA) |
| 802 | Aib-V-Aib-EIQL-Nle-HQ-(α-Me-2,6-F-Phe)-Aib-R-(Bip(OMe))-(APPA) |
| 803 | (AC$_5$C)-V-Aib-EIQL-Nle-HQ-(α-Me-2,6-F-Phe)-Aib-R-(Bip(OMe))-(APPA) |
| 804 | Aib-V-Aib-EIQL-Nle-HQ-(α-Me-2,6-F-Phe)-Aib-Cit-(Bip(OMe))-(APPA) |
| 805 | (AC$_5$C)-V-Aib-EIQL-Nle-HQ-(α-Me-2,6-F-Phe)-Aib-Cit-(Bip(OMe))-(APPA) |
| 806 | Aib-V-Aib-EIQL-Nle-HQ-(α-Me-2,6-F-Phe)-Aib-Aib-(Bip(OMe))-(APPA) |
| 807 | (AC$_5$C)-V-Aib-EIQL-Nle-HQ-(α-Me-2,6-F-Phe)-Aib-Aib-(Bip(OMe))-(APPA) |
| 808 | Aib-V-Aib-EIQL-Nle-HQ-(α-Me-2,6-F-Phe)-Aib-(α-Me-2,6-F-Phe)-Bip(OMe))-(APPA) |
| 809 | (AC$_5$C)-V-Aib-EIQL-Nle-HQ-(α-Me-2,6-F-Phe)-Aib-(α-Me-2,6-F-Phe)-(Bip(OMe))-(APPA) |

TABLE 2 (xviii)

List of short-chain peptides prepared

| Seq. ID. No. | Sequence of short-chain peptides |
|---|---|
| 810 | Aib-V-Aib-EIQ-(α-Me-2,6-F-Phe)-Nle-HQ-Har-AR-(Bip(OMe))-(APPA) |
| 811 | (AC$_5$C)-V-Aib-EIQ-(α-Me-2,6-F-Phe)-Nle-HQ-Har-AR-(Bip(OMe))-(APPA) |
| 812 | Aib-V-Aib-EIQ-(α-Me-2,6-F-Phe)-Nle-HQ-Har-A-Cit-(Bip(OMe))-(APPA) |
| 813 | (AC$_5$C)-V-Aib-EIQ-(α-Me-2,6-F-Phe)-Nle-HQ-Har-A-Cit-(Bip(OMe))-(APPA) |
| 814 | Aib-V-Aib-EIQ-(α-Me-2,6-F-Phe)-Nle-HQ-Har-A-Aib-(Bip(OMe))-(APPA) |
| 815 | (AC$_5$C)-V-Aib-EIQ-(α-Me-2,6-F-Phe)-Nle-HQ-Har-A-Aib-(Bip(OMe))-(APPA) |
| 816 | Aib-V-Aib-EIQ-(α-Me-2,6-F-Phe)-Nle-HQ-Har-A-(α-Me-2,6-F-Phe)-(Bip(OMe))-(APPA) |
| 817 | (AC$_5$C)-V-Aib-EIQ-(α-Me-2,6-F-Phe)-Nle-HQ-Har-A-(α-Me-2,6-F-Phe)-(Bip(OMe))-(APPA) |
| 818 | Aib-V-Aib-EIQ-(α-Me-2,6-F-Phe)-Nle-HQ-Har-Aib-R-(Bip(OMe))-(APPA) |

TABLE 2 (xviii)-continued

List of short-chain peptides prepared

| Seq. ID. No. | Sequence of short-chain peptides |
|---|---|
| 819 | (AC$_5$C)-V-Aib-EIQ-(α-Me-2,6-F-Phe)-Nle-HQ-Har-Aib-R-(Bip(OMe))-(APPA) |
| 820 | Aib-V-Aib-EIQ-(α-Me-2,6-F-Phe)-Nle-HQ-Har-Aib-Cit-(Bip(OMe))-(APPA) |
| 821 | (AC$_5$C)-V-Aib-EIQ-(α-Me-2,6-F-Phe)-Nle-HQ-Har-Aib-Cit-(Bip(OMe))-(APPA) |
| 822 | Aib-V-Aib-EIQ-(α-Me-2,6-F-Phe)-Nle-HQ-Har-Aib-Aib-(Bip(OMe))-(APPA) |
| 823 | (AC$_5$C)-V-Aib-EIQ-(α-Me-2,6-F-Phe)-Nle-HQ-Har-Aib-Aib-(Bip(OMe))-(APPA) |
| 824 | Aib-V-Aib-EIQ-(α-Me-2,6-F-Phe)-Nle-HQ-Har-Aib-(α-Me-2,6-F-Phe)-(Bip(OMe))-(APPA) |
| 825 | (AC$_5$C)-V-Aib-EIQ-(α-Me-2,6-F-Phe)-Nle-HQ-Har-Aib-(α-Me-2,6-F-Phe)-(Bip(OMe))-(APPA) |
| 826 | Aib-V-Aib-EIQ-(α-Me-2,6-F-Phe)-Nle-HQ-Orn-AR-(Bip(OMe))-(APPA) |
| 827 | (AC$_5$C)-V-Aib-EIQ-(α-Me-2,6-F-Phe)-Nle-HQ-Orn-AR-(Bip(OMe))-(APPA) |
| 828 | Aib-V-Aib-EIQ-(α-Me-2,6-F-Phe)-Nle-HQ-Orn-A-Cit-(Bip(OMe))-(APPA) |
| 829 | (AC$_5$C)-V-Aib-EIQ-(α-Me-2,6-F-Phe)-Nle-HQ-Orn-A-Cit-(Bip(OMe))-(APPA) |
| 830 | Aib-V-Aib-EIQ-(α-Me-2,6-F-Phe)-Nle-HQ-Orn-A-Aib-(Bip(OMe))-(APPA) |
| 831 | (AC$_5$C)-V-Aib-EIQ-(α-Me-2,6-F-Phe)-Nle-HQ-Orn-A-Aib-(Bip(OMe))-(APPA) |
| 832 | Aib-V-Aib-EIQ-(α-Me-2,6-F-Phe)-Nle-HQ-Orn-A-(α-Me-2,6-F-Phe)-(Bip(OMe))-(APPA) |
| 833 | (AC$_5$C)-V-Aib-EIQ-(α-Me-2,6-F-Phe)-Nle-HQ-Orn-A-(α-Me-2,6-F-Phe)-(Bip(OMe))-(APPA) |
| 834 | Aib-V-Aib-EIQ-(α-Me-2,6-F-Phe)-Nle-HQ-Orn-Aib-R-(Bip(OMe))-(APPA) |
| 835 | (AC$_5$C)-V-Aib-EIQ-(α-Me-2,6-F-Phe)-Nle-HQ-Orn-Aib-R-(Bip(OMe))-(APPA) |
| 836 | Aib-V-Aib-EIQ-(α-Me-2,6-F-Phe)-Nle-HQ-Orn-Aib-Cit-(Bip(OMe))-(APPA) |
| 837 | (AC$_5$C)-V-Aib-EIQ-(α-Me-2,6-F-Phe)-Nle-HQ-Orn-Aib-Cit-(Bip(OMe))-(APPA) |
| 838 | Aib-V-Aib-EIQ-(α-Me-2,6-F-Phe)-Nle-HQ-Orn-Aib-Aib-(Bip(OMe))-(APPA) |
| 839 | (AC$_5$C)-V-Aib-EIQ-(α-Me-2,6-F-Phe)-Nle-HQ-Orn-Aib-Aib-(Bip(OMe))-(APPA) |
| 840 | Aib-V-Aib-EIQ-(α-Me-2,6-F-Phe)-Nle-HQ-Orn-Aib-(α-Me-2,6-F-Phe)-(Bip(OMe))-(APPA) |
| 841 | (AC$_5$C)-V-Aib-EIQ-(α-Me-2,6-F-Phe)-Nle-HQ-Orn-Aib-(α-Me-2,6-F-Phe)-(Bip(OMe))-(APPA) |
| 842 | Aib-V-Aib-EIQ-(α-Me-2,6-F-Phe)-Nle-HQ-Cit-AR-(Bip(OMe))-(APPA) |
| 843 | (AC$_5$C)-V-Aib-EIQ-(α-Me-2,6-F-Phe)-Nle-HQ-Cit-AR-(Bip(OMe))-(APPA) |
| 844 | Aib-V-Aib-EIQ-(α-Me-2,6-F-Phe)-Nle-HQ-Cit-A-Cit-(Bip(OMe))-(APPA) |
| 845 | (AC$_5$C)-V-Aib-EIQ-(α-Me-2,6-F-Phe)-Nle-HQ-Cit-A-Cit-(Bip(OMe))-(APPA) |
| 846 | Aib-V-Aib-EIQ-(α-Me-2,6-F-Phe)-Nle-HQ-Cit-A-Aib-(Bip(OMe))-(APPA) |
| 847 | (AC$_5$C)-V-Aib-EIQ-(α-Me-2,6-F-Phe)-Nle-HQ-Cit-A-Aib-(Bip(OMe))-(APPA) |
| 848 | Aib-V-Aib-EIQ-(α-Me-2,6-F-Phe)-Nle-HQ-Cit-A-(α-Me-2,6-F-Phe)-(Bip(OMe))-(APPA) |

TABLE 2 (xviii)-continued

List of short-chain peptides prepared

| Seq. ID. No. | Sequence of short-chain peptides |
|---|---|
| 849 | (AC$_5$C)-V-Aib-EIQ-(α-Me-2,6-F-Phe)-Nle-HQ-Cit-A-(α-Me-2,6-F-Phe)-(Bip(OMe))-(APPA) |
| 850 | Aib-V-Aib-EIQ-(α-Me-2,6-F-Phe)-Nle-HQ-Cit-Aib-R-(Bip(OMe))-(APPA) |
| 851 | (AC$_5$C)-V-Aib-EIQ-(α-Me-2,6-F-Phe)-Nle-HQ-Cit-Aib-R-(Bip(OMe))-(APPA) |
| 852 | Aib-V-Aib-EIQ-(α-Me-2,6-F-Phe)-Nle-HQ-Cit-Aib-Cit-(Bip(OMe))-(APPA) |
| 853 | (AC$_5$C)-V-Aib-EIQ-(α-Me-2,6-F-Phe)-Nle-HQ-Cit-Aib-Cit-(Bip(OMe))-(APPA) |
| 854 | Aib-V-Aib-EIQ-(α-Me-2,6-F-Phe)-Nle-HQ-Cit-Aib-Aib-(Bip(OMe))-(APPA) |
| 855 | (AC$_5$C)-V-Aib-EIQ-(α-Me-2,6-F-Phe)-Nle-HQ-Cit-Aib-Aib-(Bip(OMe))-(APPA) |
| 856 | Aib-V-Aib-EIQ-(α-Me-2,6-F-Phe)-Nle-HQ-Cit-Aib-(α-Me-2,6-F-Phe)-(Bip(OMe))-(APPA) |
| 857 | (AC$_5$C)-V-Aib-EIQ-(α-Me-2,6-F-Phe)-Nle-HQ-Cit-Aib-(α-Me-2,6-F-Phe)-(Bip(OMe))-(APPA) |
| 858 | Aib-V-Aib-EIQ-(α-Me-2,6-F-Phe)-Nle-HQ-(HoCit)-AR-(Bip(OMe))-(APPA) |
| 859 | (AC$_5$C)-V-Aib-EIQ-(α-Me-2,6-F-Phe)-Nle-HQ-(HoCit)-AR-(Bip(OMe))-(APPA) |
| 860 | Aib-V-Aib-EIQ-(α-Me-2,6-F-Phe)-Nle-HQ-(HoCit)-A-Cit-(Bip(OMe))-(APPA) |
| 861 | (AC$_5$C)-V-Aib-EIQ-(α-Me-2,6-F-Phe)-Nle-HQ-(HoCit)-A-Cit-(Bip(OMe))-(APPA) |
| 862 | Aib-V-Aib-EIQ-(α-Me-2,6-F-Phe)-Nle-HQ-(HoCit)-A-Aib-(Bip(OMe))-(APPA) |
| 863 | (AC$_5$C)-V-Aib-EIQ-(α-Me-2,6-F-Phe)-Nle-HQ-(HoCit)-A-Aib-(Bip(OMe))-(APPA) |
| 864 | Aib-V-Aib-EIQ-(α-Me-2,6-F-Phe)-Nle-HQ-(HoCit)-A-(α-Me-2,6-F-Phe)-(Bip(OMe))-(APPA) |
| 865 | (AC$_5$C)-V-Aib-EIQ-(α-Me-2,6-F-Phe)-Nle-HQ-(HoCit)-A-(α-Me-2,6-F-Phe)-(Bip(OMe))-(APPA) |
| 866 | Aib-V-Aib-EIQ-(α-Me-2,6-F-Phe)-Nle-HQ-(HoCit)-Aib-R-(Bip(OMe))-(APPA) |
| 867 | (AC$_5$C)-V-Aib-EIQ-(α-Me-2,6-F-Phe)-Nle-HQ-(HoCit)-Aib-R-(Bip(OMe))-(APPA) |
| 868 | Aib-V-Aib-EIQ-(α-Me-2,6-F-Phe)-Nle-HQ-(HoCit)-Aib-Cit-(Bip(OMe))-(APPA) |
| 869 | (AC$_5$C)-V-Aib-EIQ-(α-Me-2,6-F-Phe)-Nle-HQ-(HoCit)-Aib-Cit-(Bip(OMe))-(APPA) |
| 870 | Aib-V-Aib-EIQ-(α-Me-2,6-F-Phe)-Nle-HQ-(HoCit)-Aib-Aib-(Bip(OMe))-(APPA) |
| 871 | (AC$_5$C)-V-Aib-EIQ-(α-Me-2,6-F-Phe)-Nle-HQ-(HoCit)-Aib-Aib-(Bip(OMe))-(APPA) |
| 872 | Aib-V-Aib-EIQ-(α-Me-2,6-F-Phe)-Nle-HQ-(HoCit)-Aib-(α-Me-2,6-F-Phe)-(Bip(OMe))-(APPA) |
| 873 | (AC$_5$C)-V-Aib-EIQ-(α-Me-2,6-F-Phe)-Nle-HQ-(HoCit)-Aib-(α-Me-2,6-F-Phe)-(Bip(OMe))-(APPA) |
| 874 | Aib-V-Aib-EIQ-(α-Me-2,6-F-Phe)-Nle-HQ-(α-Me-2,6-F-Phe)-AR-(Bip(OMe))-(APPA) |

TABLE 2 (xviii)-continued

List of short-chain peptides prepared

| Seq. ID. No. | Sequence of short-chain peptides |
|---|---|
| 875 | (AC$_5$C)-V-Aib-EIQ-(α-Me-2,6-F-Phe)-Nle-HQ-(α-Me-2,6-F-Phe)-AR-(Bip(OMe))-(APPA) |
| 876 | Aib-V-Aib-EIQ-(α-Me-2,6-F-Phe)-Nle-HQ-(α-Me-2,6-F-Phe)-A-Cit-(Bip(OMe))-(APPA) |
| 877 | (AC$_5$C)-V-Aib-EIQ-(α-Me-2,6-F-Phe)-Nle-HQ-(α-Me-2,6-F-Phe)-A-Cit-(Bip(OMe))-(APPA) |
| 878 | Aib-V-Aib-EIQ-(α-Me-2,6-F-Phe)-Nle-HQ-(α-Me-2,6-F-Phe)-A-Aib-(Bip(OMe))-(APPA) |
| 879 | (AC$_5$C)-V-Aib-EIQ-(α-Me-2,6-F-Phe)-Nle-HQ-(α-Me-2,6-F-Phe)-A-Aib-(Bip(OMe))-(APPA) |
| 880 | Aib-V-Aib-EIQ-(α-Me-2,6-F-Phe)-Nle-HQ-(α-Me-2,6-F-Phe)-A-(α-Me-2,6-F-Phe)-(Bip(OMe))-(APPA) |
| 881 | (AC$_5$C)-V-Aib-EIQ-(α-Me-2,6-F-Phe)-Nle-HQ-(α-Me-2,6-F-Phe)-A-(α-Me-2,6-F-Phe)-(Bip(OMe))-(APPA) |
| 882 | Aib-V-Aib-EIQ-(α-Me-2,6-F-Phe)-Nle-HQ-(α-Me-2,6-F-Phe)-Aib-R-(Bip(OMe))-(APPA) |
| 883 | (AC$_5$C)-V-Aib-EIQ-(α-Me-2,6-F-Phe)-Nle-HQ-(α-Me-2,6-F-Phe)-Aib-R-(Bip(OMe))-(APPA) |
| 884 | Aib-V-Aib-EIQ-(α-Me-2,6-F-Phe)-Nle-HQ-(α-Me-2,6-F-Phe)-Aib-Cit-(Bip(OMe))-(APPA) |
| 885 | (AC$_5$C)-V-Aib-EIQ-(α-Me-2,6-F-Phe)-Nle-HQ-(α-Me-2,6-F-Phe)-Aib-Cit-(Bip(OMe))-(APPA) |
| 886 | Aib-V-Aib-EIQ-(α-Me-2,6-F-Phe)-Nle-HQ-(α-Me-2,6-F-Phe)-Aib-Aib-(Bip(OMe))-(APPA) |
| 887 | (AC$_5$C)-V-Aib-EIQ-(α-Me-2,6-F-Phe)-Nle-HQ-(α-Me-2,6-F-Phe)-Aib-Aib-(Bip(OMe))-(APPA) |
| 888 | Aib-V-Aib-EIQ-(α-Me-2,6-F-Phe)-Nle-HQ-(α-Me-2,6-F-Phe)-Aib-(α-Me-2,6-F-Phe)-(Bip(OMe))-(APPA) |
| 889 | (AC$_5$C)-V-Aib-EIQ-(α-Me-2,6-F-Phe)-Nle-HQ-(α-Me-2,6-F-Phe)-Aib-(α-Me-2,6-F-Phe)-(Bip(OMe))-(APPA) |

TABLE 2 (xix)

List of short-chain peptides prepared

| Seq. ID. No. | Sequence of short-chain peptides |
|---|---|
| 890 | Aib-V-Aib-EIQLMHQ-Har-AK-(αMe-Bip(OMe))-(APPA) |
| 891 | Aib-V-Aib-EIQL-Nle-HQ-Har-AK-(αMe-Bip(OMe))-(APPA) |
| 892 | V-Aib-V-Aib-EIQLMHQ-Har-AK-(Bip(OMe))-(αMe-APPA) |
| 893 | V-Aib-V-Aib-EIQL-Nle-HQ-Har-AK-(Bip(OMe))-(αMe-APPA) |
| 894 | (αMe-V)-(AC$_5$C)-V-Aib-EIQLMHQ-Har-AK-(Bip(OMe))-(αMe-APPA) |
| 895 | (αMe-V)-(AC$_5$C)-V-Aib-EIQL-Nle-HQ-Har-AK-(Bip(OMe))-(αMe-APPA) |
| 896 | (NMe-V)-(AC$_5$C)-V-Aib-EIQLMHQ-Har-AK-(Bip(OMe))-(αMe-APPA) |
| 897 | (NMe-V)-(AC$_5$C)-V-Aib-EIQL-Nle-HQ-Har-AK-(Bip(OMe))-(αMe-APPA) |
| 898 | Aib-V-Aib-EIQLMHQ-Har-A-Har-(αMe-Bip(OMe))-(APPA) |
| 899 | Aib-V-Aib-EIQL-Nle-HQ-Har-A-Har-(αMe-Bip(OMe))-(APPA) |

TABLE 2 (xix)-continued

List of short-chain peptides prepared

| Seq. ID. No. | Sequence of short-chain peptides |
|---|---|
| 900 | Aib-V-Aib-EIQLMHQ-Har-A-Har-(Bip(OMe))-(αMe-APPA) |
| 901 | Aib-V-Aib-EIQL-Nle-HQ-Har-A-Har-(Bip(OMe))-(αMe-APPA) |
| 902 | V-Aib-V-Aib-EIQLMHQ-Har-A-Har-(αMe-Bip(OMe))-(APPA) |
| 903 | V-Aib-V-Aib-EIQL-Nle-HQ-Har-A-Har-(αMe-Bip(OMe))-(APPA) |
| 904 | V-Aib-V-Aib-EIQLMHQ-Har-A-Har-(Bip(OMe))-(αMe-APPA) |
| 905 | V-Aib-V-Aib-EIQL-Nle-HQ-Har-A-Har-(Bip(OMe))-(αMe-APPA) |
| 906 | (αMe-V)-(AC$_5$C)-V-Aib-EIQLMHQ-Har-A-Har-(Bip(OMe))-(αMe-APPA) |
| 907 | (αMe-V)-(AC$_5$C)-V-Aib-EIQL-Nle-HQ-Har-A-Har-(Bip(OMe))-(αMe-APPA) |
| 908 | (NMe-V)-(AC$_5$C)-V-Aib-EIQLMHQ-Har-A-Har-(Bip(OMe))-(αMe-APPA) |
| 909 | (NMe-V)-(AC$_5$C)-V-Aib-EIQL-Nle-HQ-Har-A-Har-(Bip(OMe))-(αMe-APPA) |
| 910 | Aib-V-Aib-EIQL-(αMe-M)-HQ-Har-A-Har-(αMe-Bip(OMe))-(APPA) |
| 911 | Aib-V-Aib-EIQL-(αMe-Nle)-HQ-Har-A-Har-(αMe-Bip(OMe))-(APPA) |
| 912 | Aib-V-Aib-EIQL-(αMe-M)-HQ-Har-A-Har-(Bip(OMe))-(αMe-APPA) |
| 913 | Aib-V-Aib-EIQL-(αMe-Nle)-HQ-Har-A-Har-(Bip(OMe))-(αMe-APPA) |
| 914 | V-Aib-V-Aib-EIQL-(αMe-M)-HQ-Har-A-Har-(αMe-Bip(OMe))-(APPA) |
| 915 | V-Aib-V-Aib-EIQL-(αMe-Nle)-HQ-Har-A-Har-(αMe-Bip(OMe))-(APPA) |
| 916 | V-(AC$_3$C)-V-Aib-EIQL-(αMe-M)-HQ-Har-A-Har-(αMe-Bip(OMe))-(APPA) |
| 917 | V-(AC$_3$C)-V-Aib-EIQL-(αMe-Nle)-HQ-Har-A-Har-(αMe-Bip(OMe))-(APPA) |
| 918 | V-(AC$_5$C)-V-Aib-EIQL-(αMe-M)-HQ-Har-A-Har-(αMe-Bip(OMe))-(APPA) |
| 919 | V-(AC$_5$C)-V-Aib-EIQL-(αMe-Nle)-HQ-Har-A-Har-(αMe-Bip(OMe))-(APPA) |
| 920 | V-Aib-V-Aib-EIQL-(αMe-M)-HQ-Har-A-Har-(Bip(OMe))-(αMe-APPA) |
| 921 | V-Aib-V-Aib-EIQL-(αMe-Nle)-HQ-Har-A-Har-(Bip(OMe))-(αMe-APPA) |
| 922 | V-(AC$_3$C)-V-Aib-EIQL-(αMe-M)-HQ-Har-A-Har-(Bip(OMe))-(αMe-APPA) |
| 923 | V-(AC$_3$C)-V-Aib-EIQL-(αMe-Nle)-HQ-Har-A-Har-(Bip(OMe))-(αMe-APPA) |
| 924 | V-(AC$_5$C)-V-Aib-EIQL-(αMe-M)-HQ-Har-A-Har-(Bip(OMe))-(αMe-APPA) |
| 925 | V-(AC$_5$C)-V-Aib-EIQL-(αMe-Nle)-HQ-Har-A-Har-(Bip(OMe))-(αMe-APPA) |
| 926 | (αMe-V)-(AC$_5$C)-V-Aib-EIQL-(αMe-M)-HQ-Har-A-Har-(Bip(OMe))-(αMe-APPA) |
| 927 | (αMe-V)-(AC$_5$C)-V-Aib-EIQL-(αMe-Nle)-HQ-Har-A-Har-(Bip(OMe))-(αMe-APPA) |
| 928 | (NMe-V)-(AC$_5$C)-V-Aib-EIQL-(αMe-M)-HQ-Har-A-Har-(Bip(OMe))-(αMe-APPA) |
| 929 | (NMe-V)-(AC$_5$C)-V-Aib-EIQL-(αMe-Nle)-HQ-Har-A-Har-(Bip(OMe))-(αMe-APPA) |
| 930 | Aib-V-Aib-EIQL-(αMe-M)-HQ-Har-A-Har-(αMe-2FPhe)-(APPA) |
| 931 | Aib-V-Aib-EIQL-(αMe-Nle)-HQ-Har-A-Har-(αMe-2FPhe)-(APPA) |
| 932 | V-Aib-V-Aib-EIQL-(αMe-M)-HQ-Har-A-Har-(αMe-2FPhe)-(αMe-APPA) |
| 933 | V-Aib-V-Aib-EIQL-(αMe-Nle)-HQ-Har-A-Har-(αMe-2FPhe)-(αMe-APPA) |

TABLE 2 (xix)-continued

List of short-chain peptides prepared

| Seq. ID. No. | Sequence of short-chain peptides |
|---|---|
| 934 | V-(AC$_3$C)-V-Aib-EIQL-(αMe-M)-HQ-Har-A-Har-(αMe—2FPhe)-(αMe-APPA) |
| 935 | V-(AC$_3$C)-V-Aib-EIQL-(αMe-Nle)-HQ-Har-A-Har-(αMe—2FPhe)-(αMe-APPA) |
| 936 | V-(AC$_5$C)-V-Aib-EIQL-(αMe-M)-HQ-Har-A-Har-(αMe—2FPhe)-(αMe-APPA) |
| 937 | V-(AC$_5$C)-V-Aib-EIQL-(αMe-Nle)-HQ-Har-A-Har-(αMe—2FPhe)-(αMe-APPA) |
| 938 | (αMe-V)-(AC$_5$C)-V-Aib-EIQL-(αMe-M)-HQ-Har-A-Har-(αMe—2FPhe)-(αMe-APPA) |
| 939 | (αMe-V)-(AC$_5$C)-V-Aib-EIQL-(αMe-Nle)-HQ-Har-A-Har-(αMe—2FPhe)-(αMe-APPA) |
| 940 | (NMe-V)-(AC$_5$C)-V-Aib-EIQL-(αMe-M)-HQ-Har-A-Har-(αMe—2FPhe)-(αMe-APPA) |
| 941 | (NMe-V)-(AC$_5$C)-V-Aib-EIQL-(αMe-Nle)-HQ-Har-A-Har-(αMe—2FPhe)-(αMe-APPA) |
| 942 | Aib-V-Aib-EIQL-(αMe-M)-HQ-Har-A-Har-(αMe-Trp)-(APPA) |
| 943 | Aib-V-Aib-EIQL-(αMe-Nle)-HQ-Har-A-Har-(αMe-Trp)-(APPA) |
| 944 | (AC$_3$C)-V-Aib-EIQL-(αMe-M)-HQ-Har-A-Har-(αMe-Trp)-(APPA) |
| 945 | (AC$_3$C)-V-Aib-EIQL-(αMe-Nle)-HQ-Har-A-Har-(αMe-Trp)-(APPA) |
| 946 | (AC$_5$C)-V-Aib-EIQL-(αMe-M)-HQ-Har-A-Har-(αMe-Trp)-(APPA) |
| 947 | (AC$_5$C)-V-Aib-EIQL-(αMe-Nle)-HQ-Har-A-Har-(αMe-Trp)-(APPA) |
| 948 | Aib-V-Aib-EIQL-(αMe-M)-HQ-Har-A-Har-(αMe-Trp)-(αMe-APPA) |
| 949 | Aib-V-Aib-EIQL-(αMe-Nle)-HQ-Har-A-Har-(αMe-Trp)-(αMe-APPA) |
| 950 | V-(AC$_3$C)-V-Aib-EIQL-(αMe-M)-HQ-Har-A-Har-(αMe-Trp)-(αMe-APPA) |
| 951 | V-(AC$_3$C)-V-Aib-EIQL-(αMe-Nle)-HQ-Har-A-Har-(αMe-Trp)-(αMe-APPA) |
| 952 | V-(AC$_5$C)-V-Aib-EIQL-(αMe-M)-HQ-Har-A-Har-(αMe-Trp)-(αMe-APPA) |
| 953 | V-(AC$_5$C)-V-Aib-EIQL-(αMe-Nle)-HQ-Har-A-Har-(αMe-Trp)-(αMe-APPA) |
| 954 | (αMe-V)-(AC$_5$C)-V-Aib-EIQL-(αMe-M)-HQ-Har-A-Har-(αMe-Trp)-(αMe-APPA) |
| 955 | (αMe-V)-(AC$_5$C)-V-Aib-EIQL-(αMe-Nle)-HQ-Har-A-Har-(αMe-Trp)-(αMe-APPA) |

In Vitro and In Vivo Studies of Novel Short-Chain Peptides:

The short-chain peptides prepared as described above were tested for
a) In vitro Rat PTH-1 R agonist activity (Cyclic AMP determination, in UMR-106 cells);
b) Stability of peptides in human plasma, simulated gastric fluid, intestinal fluid and liver microsomes (ex-vivo); and
c) In vivo anti-osteoporosis activity testing in OVX rat model.
a) In Vitro Rat PTH-1 R Agonist Activity (Cyclic AMP Determination, in UMR-106 Cells):

The PTHR is a GPCR and the PTHR agonist binds to it and through signal transduction causes activation of adenylate cyclase and raises intracellular cAMP levels. To monitor agonistic activity of new compounds, UMR-106 rat osteosarcoma cells (Source ATCC) endogenously expresses rat PTHR, especially, PTH-1R was treated with various concentration of test compounds and amount of cAMP released were determined. UMR-106 cells were cultured in DMEM nutrition media (Sigma) containing 10% Fetal Bovine Serum (FBS) and 1× Penstrep. Cultured cells were plated at a density of 5×10$^4$ cells per well in DMEM media supplemented with 10% FBS, in 96-well tissue culture plates and grown for 2 days before the efficacy assays. On the day of assay, the growth medium was carefully removed by suction and cells were washed once with 200 µl of PBS, incubated in 90 µl reaction media (plain DMEM media, low glucose, 0.1% BSA (Sigma) and 1 mM 3-isobutyl-1-methylxanthine (Sigma), at 37° C. for 30 min and then treated with 10 µl of test compounds (concentrations 1, 10 and 100 nM) in 90 µl of reaction media and incubated at room temperature for 30 min. The medium was aspirated, 60 µl of lysis buffer, enzyme donor (ED) substrate reagent and cAMP-antibody reagent was added and plates were incubated at room temperature for 1 h. Further, enzyme acceptor (EA) reagent (40 µl) was added and luminescence was read after incubation for 2 h at room temperature in Top Count L-Max Luminometer (each well reading for 20 sec). From cAMP standard curve, the amount of released cAMP was determined. Data is calculated as percent of control (Vehicle: water) and expressed as Mean±SD. The in-vitro PTH-1 receptor agonistic activities of representative peptides are listed in Table 3. The data was analysed by non-linear regression curve fit (Sigmoidal dose) to determine the $EC_{50}$ of the selected test compounds (Carter P. H., et al., PNAS, 2007, 104(16), 6846-6851; Merritt B. S., J. Cellular Physiology, 2005, 152(3), 520-528; Reid I. R., Am. J. Physiol. Endocrinol. Metab., 253, 1987, E45-E50).

TABLE 3

In vitro PTH-1 R agonistic activity of selected test compd, amount of cAMP released with respect to control

| Compounds | 1 nM | 10 nM | 100 nM |
| --- | --- | --- | --- |
| PTH (1-34) | 41 ± 0.12 | 97 ± 0.10 | 100 ± 0.06 |
| Seq. ID. 9 | 16 ± 0.022 | 41 ± 0.16 | 52 ± 0.21 |
| Seq. ID. 15 | 28 ± 0.1 | 78 ± 0.02 | 99 ± 0.02 |
| Seq. ID. 20 | 79 ± 0.02 | 111 ± 0.03 | 121 ± 0.07 |
| Seq. ID. 23 | 12 ± 0.03 | 41 ± 0.10 | 69 ± 0.07 |
| Seq. ID. 30 | 19 ± 0.12 | 51 ± 0.06 | 80 ± 0.05 |
| Seq. ID. 41 | 26 ± 0.01 | 79 ± 0.02 | 97 ± 0.01 |
| Seq. ID. 49 | 16 ± 0.1 | 56 ± 0.2 | 73 ± 0.05 |
| Seq. ID. 59 | 19 ± 0.01 | 66 ± 0.01 | 84 ± 0.2 |
| Seq. ID. 65 | 34 ± 0.01 | 82 ± 0.16 | 104 ± 0.12 |
| Seq. ID. 78 | 23 ± 0.03 | 73 ± 0.01 | 93 ± 0.3 |
| Seq. ID. 91 | 42 ± 0.1 | 101 ± 0.2 | 110 ± 0.03 |
| Seq. ID. 110 | 12 ± 0.04 | 39 ± 0.06 | 72 ± 0.02 |
| Seq. ID. 132 | 29 ± 0.05 | 82 ± 0.07 | 101 ± 0.01 |
| Seq. ID. 156 | 31 ± 0.2 | 89 ± 0.03 | 106 ± 0.04 |
| Seq. ID. 174 | 31 ± 0.02 | 72 ± 0.09 | 100 ± 0.11 |
| Seq. ID. 198 | 32 ± 0.02 | 71 ± 0.16 | 99 ± 0.21 |
| Seq. ID. 212 | 34 ± 0.09 | 88 ± 0.07 | 116 ± 0.04 |
| Seq. ID. 238 | 38 ± 0.13 | 91 ± 0.12 | 120 ± 0.11 |
| Seq. ID. 256 | 28 ± 0.11 | 71 ± 0.11 | 87 ± 0.15 |
| Seq. ID. 271 | 46 ± 0.1 | 108 ± 0.01 | 116 ± 0.11 |
| Seq. ID. 292 | 39 ± 0.11 | 104 ± 0.09 | 120 ± 0.06 |
| Seq. ID. 311 | 26 ± 0.08 | 68 ± 0.06 | 86 ± 0.01 |
| Seq. ID. 325 | 38 ± 0.9 | 98 ± 0.03 | 116 ± 0.01 |
| Seq. ID. 330 | 18 ± 0.12 | 51 ± 0.15 | 72 ± 0.18 |
| Seq. ID. 346 | 21 ± 0.02 | 51 ± 0.12 | 69 ± 0.17 |
| Seq. ID. 351 | 38 ± 0.15 | 79 ± 0.01 | 119 ± 0.06 |
| Seq. ID. 372 | 32 ± 0.02 | 71 ± 0.16 | 99 ± 0.21 |
| Seq. ID. 397 | 38 ± 0.11 | 102 ± 0.09 | 117 ± 0.06 |
| Seq. ID. 418 | 29 ± 0.11 | 52 ± 0.07 | 69 ± 0.01 |
| Seq. ID. 429 | 39 ± 0.11 | 101 ± 0.12 | 120 ± 0.10 |
| Seq. ID. 444 | 26 ± 0.022 | 67 ± 0.46 | 81 ± 0.41 |
| Seq. ID. 461 | 56 ± 0.09 | 101 ± 0.07 | 126 ± 0.04 |
| Seq. ID. 470 | 36 ± 0.09 | 88 ± 0.07 | 116 ± 0.04 |
| Seq. ID. 479 | 48 ± 0.11 | 99 ± 0.10 | 112 ± 0.13 |
| Seq. ID. 486 | 34 ± 0.01 | 82 ± 0.16 | 104 ± 0.12 |
| Seq. ID. 501 | 28 ± 0.11 | 71 ± 0.11 | 87 ± 0.15 |
| Seq. ID. 514 | 19 ± 0.12 | 64 ± 0.04 | 80 ± 0.01 |
| Seq. ID. 521 | 21 ± 0.02 | 51 ± 0.12 | 69 ± 0.17 |
| Seq. ID. 540 | 16 ± 0.02 | 57 ± 0.43 | 75 ± 0.21 |
| Seq. ID. 553 | 38 ± 0.9 | 98 ± 0.03 | 116 ± 0.01 |
| Seq. ID. 598 | 38 ± 0.15 | 79 ± 0.01 | 119 ± 0.06 |
| Seq. ID. 609 | 39 ± 0.11 | 101 ± 0.12 | 120 ± 0.10 |
| Seq. ID. 637 | 36 ± 0.12 | 98 ± 0.06 | 110 ± 0.01 |
| Seq. ID. 647 | 56 ± 0.09 | 101 ± 0.07 | 126 ± 0.04 |
| Seq. ID. 678 | 48 ± 0.11 | 102 ± 0.10 | 112 ± 0.13 |
| Seq. ID. 694 | 19 ± 0.12 | 64 ± 0.04 | 80 ± 0.01 |
| Seq. ID. 712 | 15 ± 0.01 | 54 ± 0.4 | 69 ± 0.03 |
| Seq. ID. 733 | 36 ± 0.12 | 98 ± 0.06 | 110 ± 0.01 |
| Seq. ID. 751 | 34 ± 0.09 | 88 ± 0.07 | 116 ± 0.04 |
| Seq. ID. 781 | 16 ± 0.02 | 57 ± 0.43 | 75 ± 0.21 |
| Seq. ID. 799 | 38 ± 0.03 | 99 ± 0.1 | 106 ± 0.03 |
| Seq. ID. 813 | 82 ± 0.05 | 109 ± 0.1 | 110 ± 0.7 |
| Seq. ID. 820 | 14 ± 0.3 | 48 ± 0.03 | 66 ± 0.05 |
| Seq. ID. 841 | 32 ± 0.11 | 74 ± 0.14 | 100 ± 0.01 |
| Seq. ID. 860 | 22 ± 0.12 | 50 ± 0.15 | 70 ± 0.18 |
| Seq. ID. 872 | 19 ± 0.11 | 42 ± 0.09 | 59 ± 0.06 |
| Seq. ID. 886 | 31 ± 0.020 | 72 ± 0.17 | 100 ± 0.11 |
| Seq. ID. 899 | 38 ± 0.13 | 91 ± 0.14 | 120 ± 0.11 |
| Seq. ID. 905 | 39 ± 0.11 | 104 ± 0.09 | 120 ± 0.06 |
| Seq. ID. 917 | 46 ± 0.02 | 98 ± 0.01 | 116 ± 0.11 |

TABLE 3-continued

In vitro PTH-1 R agonistic activity of selected test compd, amount of cAMP released with respect to control

| Compounds | 1 nM | 10 nM | 100 nM |
| --- | --- | --- | --- |
| Seq. ID. 925 | 16 ± 0.022 | 41 ± 0.16 | 52 ± 0.21 |
| Seq. ID. 917 | 26 ± 0.08 | 68 ± 0.06 | 86 ± 0.01 |
| Seq. ID. 926 | 18 ± 0.12 | 51 ± 0.15 | 72 ± 0.18 |
| Seq. ID. 935 | 38 ± 0.11 | 102 ± 0.09 | 117 ± 0.06 |
| Seq. ID. 942 | 29 ± 0.11 | 52 ± 0.07 | 69 ± 0.01 |
| Seq. ID. 950 | 26 ± 0.022 | 67 ± 0.46 | 81 ± 0.41 |
| Seq. ID. 954 | 36 ± 0.09 | 88 ± 0.07 | 116 ± 0.04 | b) Stability of Peptides in Human Plasma, Simulated Gastric Fluid, Intestinal Fluid and Liver Microsomes (Ex-Vivo):

Different short-chain peptides (final concentration 2 μM) were incubated with either pooled human plasma (7.5 μL) or simulated gastric fluid (pH 1.5; composition HCl, NaCl and Pepsin) or simulated intestinal fluid (pH 7.5) or human liver microsomes, for 0, 2, 4, 6, 12 and 24 h (37° C.; 50 mM triethanolamine-HCl buffer; pH 7.8). Concentrations of human plasma/simulated gastric fluid/simulated intestinal fluid/human liver microsomes were selected in preliminary experiments to provide degradation of approximately 50% of PTH(1-34) within 1 h, therefore allowing time-dependent degradation to be viewed over 24 h. Reactions were terminated by the addition of $TFA/H_2O$ (15 mL, 10% (v/v)). The reaction products were then applied to a Vydac $C_{18}$ analytical column (4.6×250-mm) and the major degradation fragment separated from intact short-chain peptides. The column was equilibrated with $TFA/H_2O$, at a flow rate of 1 mL/min. Using 0.1% (v/v) TFA in 70% acetonitrile/$H_2O$, the concentration of acetonitrile in the eluting solvent was raised from 0% to 28% over 10 min and from 28% to 42% over 30 min. The absorbance was monitored at 206 nm using UV detector and peaks were collected manually prior to ESI-MS analysis. Area under the curve was measured for test peptides and their metabolites and percentage degradation were calculated at each time point over a period of 24 h. Stability study results of selected peptides, in human plasma, simulated gastric fluid, intestinal fluid and liver microsomes (in vitro) are listed in Table 4.

TABLE 4

Stability study results of selected short-chain peptides in human plasma, simulated gastric fluid, intestinal fluid and liver microsomes (in vitro)

| Seq. ID. No. | Human plasma[a] | Simulated gastric fluid[b] | Simulated intestinal fluid[c] | liver microsomes[d] |
| --- | --- | --- | --- | --- |
| PTH(1-34) | 97 (0.5) | 100 (0.1) | 100 (0.2) | 100 (0.1) |
| Seq. ID. 10 | 70 (9) | 100 (0.5) | 100 (0.5) | 100 (0.5) |
| Seq. ID. 14 | 69 (8) | 11 (7) | 43 (6) | 77 (2) |
| Seq. ID. 25 | 75 (8) | 12 (8) | 46 (6) | 83 (1) |
| Seq. ID. 34 | 70 (8) | 15 (8) | 41 (6) | 77 (1) |
| Seq. ID. 46 | 00 (>24) | 00 (>24) | 00 (>24) | 31 (5) |
| Seq. ID. 56 | 00 (>24) | 00 (>24) | 00 (>24) | 32 (5) |
| Seq. ID. 62 | 00 (>24) | 00 (>24) | 00 (>24) | 33 (5) |
| Seq. ID. 75 | 78 (9) | 100 (0.5) | 100 (0.5) | 100 (0.5) |
| Seq. ID. 85 | 77 (9) | 100 (0.5) | 100 (0.5) | 100 (0.5) |
| Seq. ID. 95 | 80 (9) | 100 (0.5) | 100 (0.5) | 100 (0.5) |
| Seq. ID. 100 | 00 (>24) | 49 (4) | 00 (>24) | 82 (2) |
| Seq. ID. 115 | 78 (8) | 12 (8) | 55 (6) | 79 (1) |
| Seq. ID. 142 | 80 (8) | 13 (8) | 50 (6) | 82 (1) |
| Seq. ID. 161 | 78 (8) | 14 (8) | 43 (6) | 80 (1) |
| Seq. ID. 182 | 00 (>24) | 00 (>24) | 00 (>24) | 26 (5) |
| Seq. ID. 220 | 75 (8) | 12 (8) | 46 (6) | 83 (1) |
| Seq. ID. 240 | 71 (8) | 14 (8) | 40 (6) | 78 (1) |

TABLE 4-continued

Stability study results of selected short-chain peptides in human plasma, simulated gastric fluid, intestinal fluid and liver microsomes (in vitro)

| Seq. ID. No. | Human plasma[a] | Simulated gastric fluid[b] | Simulated intestinal fluid[c] | liver microsomes[d] |
|---|---|---|---|---|
| Seq. ID. 250 | 78 (8) | 14 (8) | 43 (6) | 80 (1) |
| Seq. ID. 260 | 70 (8) | 15 (8) | 41 (6) | 77 (1) |
| Seq. ID. 270 | 78 (9) | 100 (0.5) | 100 (0.5) | 100 (0.5) |
| Seq. ID. 290 | 75 (9) | 100 (0.5) | 100 (0.5) | 100 (0.5) |
| Seq. ID. 315 | 71 (9) | 100 (0.5) | 100 (0.5) | 100 (0.5) |
| Seq. ID. 329 | 70 (9) | 100 (0.5) | 100 (0.5) | 100 (0.5) |
| Seq. ID. 345 | 70 (9) | 100 (0.5) | 100 (0.5) | 100 (0.5) |
| Seq. ID. 380 | 00 (>24) | 50 (4) | 00 (>24) | 86 (2) |
| Seq. ID. 390 | 00 (>24) | 55 (4) | 00 (>24) | 84 (2) |
| Seq. ID. 411 | 77 (8) | 14 (8) | 45 (6) | 81 (1) |
| Seq. ID. 430 | 00 (>24) | 45 (4) | 00 (>24) | 85 (2) |
| Seq. ID. 440 | 00 (>24) | 43 (4) | 00 (>24) | 84 (2) |
| Seq. ID. 460 | 71 (8) | 14 (8) | 40 (6) | 78 (1) |
| Seq. ID. 480 | 00 (>24) | 00 (>24) | 00 (>24) | 32 (5) |
| Seq. ID. 490 | 00 (>24) | 43 (4) | 00 (>24) | 84 (2) |
| Seq. ID. 510 | 00 (>24) | 41 (4) | 00 (>24) | 80 (2) |
| Seq. ID. 525 | 78 (8) | 12 (8) | 55 (6) | 79 (1) |
| Seq. ID. 550 | 80 (8) | 13 (8) | 50 (6) | 82 (1) |
| Seq. ID. 560 | 78 (8) | 14 (8) | 43 (6) | 80 (1) |
| Seq. ID. 570 | 71 (9) | 100 (0.5) | 100 (0.5) | 100 (0.5) |
| Seq. ID. 580 | 75 (8) | 12 (8) | 46 (6) | 83 (1) |
| Seq. ID. 590 | 00 (>24) | 00 (>24) | 00 (>24) | 35 (5) |
| Seq. ID. 610 | 71 (8) | 14 (8) | 40 (6) | 78 (1) |
| Seq. ID. 650 | 70 (8) | 15 (8) | 41 (6) | 77 (1) |
| Seq. ID. 690 | 70 (8) | 12 (8) | 42 (6) | 78 (1) |
| Seq. ID. 710 | 00 (>24) | 00 (>24) | 00 (>24) | 35 (5) |
| Seq. ID. 720 | 10 (>20) | 50 (4) | 00 (>24) | 86 (2) |
| Seq. ID. 730 | 05 (>22) | 55 (4) | 00 (>24) | 84 (2) |
| Seq. ID. 750 | 09 (>23) | 45 (4) | 00 (>24) | 85 (2) |
| Seq. ID. 790 | 00 (>24) | 43 (4) | 00 (>24) | 84 (2) |
| Seq. ID. 805 | 00 (>24) | 49 (4) | 00 (>24) | 82 (2) |
| Seq. ID. 811 | 00 (>24) | 52 (4) | 00 (>24) | 81 (2) |
| Seq. ID. 829 | 01 (>23) | 43 (4) | 05 (>22) | 84 (2) |
| Seq. ID. 840 | 00 (>24) | 00 (>24) | 00 (>24) | 33 (5) |
| Seq. ID. 860 | 77 (8) | 14 (8) | 45 (6) | 81 (1) |
| Seq. ID. 880 | 00 (>24) | 00 (>24) | 00 (>24) | 31 (5) |
| Seq. ID. 890 | 00 (>24) | 00 (>24) | 00 (>24) | 32 (5) |
| Seq. ID. 895 | 00 (>24) | 00 (>24) | 00 (>24) | 33 (5) |
| Seq. ID. 898 | 00 (>24) | 00 (>24) | 00 (>24) | 26 (5) |
| Seq. ID. 906 | 78 (9) | 100 (0.5) | 100 (0.5) | 100 (0.5) |
| Seq. ID. 910 | 77 (9) | 100 (0.5) | 100 (0.5) | 100 (0.5) |
| Seq. ID. 915 | 80 (9) | 100 (0.5) | 100 (0.5) | 100 (0.5) |
| Seq. ID. 920 | 00 (>24) | 00 (>24) | 00 (>24) | 35 (5) |
| Seq. ID. 925 | 78 (9) | 100 (0.5) | 100 (0.5) | 100 (0.5) |
| Seq. ID. 930 | 00 (>24) | 00 (>24) | 00 (>24) | 32 (5) |
| Seq. ID. 936 | 00 (>24) | 52 (4) | 00 (>24) | 81 (2) |
| Seq. ID. 939 | 10 (>20) | 08 (>22) | 09 (>22) | 33 (5) |
| Seq. ID. 940 | 00 (>24) | 00 (>24) | 00 (>24) | 32 (5) |
| Seq. ID. 945 | 75 (9) | 100 (0.5) | 100 (0.5) | 100 (0.5) |
| Seq. ID. 949 | 70 (9) | 100 (0.5) | 100 (0.5) | 100 (0.5) |
| Seq. ID. 950 | 00 (>24) | 00 (>24) | 00 (>24) | 35 (5) |

[a]% degradation of peptides in 24 h when incubated with human plasma and values in bracket represent half-life ($t_{1/2}$), in h;
[b]% degradation of peptides in 24 h when incubated with simulated gastric fluid and values in bracket represent half-life ($t_{1/2}$), in h;
[c]% degradation of peptides in 24 h when incubated with simulated intestinal fluid and values in bracket represent half-life ($t_{1/2}$), in h;
[d]% degradation of peptides in 24 h when incubated with liver microsomes and values in bracket represent half-life ($t_{1/2}$), in h.

c) In Vivo Anti-Osteoporosis Activity Testing in OVX Rat Model:

The ovariectomised (OVX) rats were used to study anti-osteoporosis activity of test compounds (short-chain peptides) in vivo. The OVX rats develop osteopenia due to ovarian hormone deficiency. Osteopenia can be detected as early as 14 days post OVX, increase for the next 100 days and then stabilised (Wronski T. J., et al., Calcif. Tissue Int., 43(3), 1988, 179-183).

Detailed Study Protocol to Evaluate the Effects of Anabolic Therapy on Bone Markers and Histomorphometry in OVX Animals:

10 to 11 weeks old Female Wistar Rats (150-200 g) were used. The animals were kept in individually ventilated cages in a room with controlled temperature (23°±3° C.), lighting (12:12 h light-dark cycle) and relative humidity (55±10%). Animals had free access to standard rat chow and water. Protocol for use of animals for conducting this study has been reviewed and approved by Institutional Animal Ethics Committee (IAEC).

The animals were marked with picric acid for identification and acclimatized to experimental room conditions for 2 days prior to initiation of the study. For the induction of osteoporosis, rats were bilaterally ovariectomised under anesthesia. For Ovariectomy, Incision was made on dorsa-lateral side near lumbar region of animal. After that, ovary was excised and the veins were tied with ligature before removing ovary to prevent blood loss. Then incision was sutured back with ligature. After Bilateral ovariectomy, animals were allowed to rest for 4 weeks. They were then divided into different groups (n=9) based on their body weight. The groups consisted of a no treatment control, PTH as standard and one or two groups of test compounds (short-chain peptides). The treatment was given for the duration of 6 weeks. At the last day of treatment animals were kept overnight in metabolic cages under fasting for the collection of Urine. Next day, blood was collected after 24 hours of last dosing and animals were sacrificed. Changes in biochemical parameters and bone turnover parameters (Increase in serum Calcium and decrease in Phosphate levels, Acid Phosphatase and TRAP) were evaluated in the urine and serum. After sacrificing, intact femur and tibial bones are removed and cleaned from adherent tissues, muscles and tendons; weighed and collected in formal saline (10% formaldehyde solution). Lumbar vertebra (L5) was excised, carefully cleaned and collected in formal saline. Femur, tibia and Lumbar vertebra-5 (L5) were later processed for histomorphometric evaluation (Zhang L., et al., Tohoku J Exp Med., 1998, 186(2), 131-41; Tanizawa T., et al., Toxicol Lett., 1998, 102, 399-403). Increase in serum Calcium and decrease in Phosphate levels (% change vs PTH) of selected peptides are listed in Table 5.

TABLE 5

Increase in serum Calcium and decrease in Phosphate levels (% change vs PTH/Control) in OVX Rats

| Seq. ID NO. | Dose | % increase in serum $Ca^{2+}$ Levels (mg/dl) vs control | % decrease in serum $PO_4$ Levels (mg/dl) vs control |
|---|---|---|---|
| PTH(1-34) | 20 µg/kg, sc | 100 | 100 |
| Seq. ID. 7 | 1 mg/kg, po | 90 | 88 |
| Seq. ID. 12 | 5 mg/kg, po | 118 | 102 |
| Seq. ID. 39 | 0.03 mg/kg, po | 88 | 66 |
| Seq. ID. 72 | 0.01 mg/kg, po | 49 | 77 |
| Seq. ID. 99 | 2 mg/kg, po | 99 | 89 |
| Seq. ID. 117 | 3 mg/kg, po | 110 | 99 |
| Seq. ID. 158 | 0.1 mg/kg, po | 100 | 82 |
| Seq. ID. 210 | 1 mg/kg, po | 96 | 99 |
| Seq. ID. 293 | 5 mg/kg, po | 67 | 75 |
| Seq. ID. 317 | 3 mg/kg, po | 102 | 93 |
| Seq. ID. 391 | 0.1 mg/kg, po | 82 | 59 |
| Seq. ID. 407 | 0.03 mg/kg, po | 77 | 81 |
| Seq. ID. 469 | 0.01 mg/kg, po | 43 | 65 |
| Seq. ID. 511 | 1 mg/kg, po | 84 | 88 |
| Seq. ID. 556 | 5 mg/kg, po | 77 | 84 |
| Seq. ID. 599 | 0.03 mg/kg, po | 110 | 90 |
| Seq. ID. 607 | 0.01 mg/kg, po | 78 | 88 |
| Seq. ID. 649 | 2 mg/kg, po | 86 | 82 |

TABLE 5-continued

Increase in serum Calcium and decrease in Phosphate
levels (% change vs PTH/Control) in OVX Rats

| Seq. ID NO. | Dose | % increase in serum $Ca^{2+}$ Levels (mg/dl) vs control | % decrease in serum $PO_4$ Levels (mg/dl) vs control |
|---|---|---|---|
| Seq. ID. 686 | 3 mg/kg, po | 84 | 80 |
| Seq. ID. 742 | 0.1 mg/kg, po | 89 | 92 |
| Seq. ID. 779 | 1 mg/kg, po | 67 | 56 |
| Seq. ID. 798 | 5 mg/kg, po | 88 | 82 |
| Seq. ID. 801 | 3 mg/kg, po | 59 | 65 |
| Seq. ID. 814 | 0.02 mg/kg, po | 99 | 95 |
| Seq. ID. 833 | 0.05 mg/kg, po | 86 | 78 |
| Seq. ID. 847 | 0.5 mg/kg, po | 77 | 79 |
| Seq. ID. 893 | 0.3 mg/kg, po | 108 | 89 |
| Seq. ID. 902 | 0.8 mg/kg, po | 110 | 98 |
| Seq. ID. 911 | 10 mg/kg, po | 121 | 97 |
| Seq. ID. 929 | 2 mg/kg, po | 121 | 90 |
| Seq. ID. 941 | 0.9 mg/kg, po | 99 | 95 |

The In vitro DRC study (in Rat PTH-1 R assay) data ($EC_{50}$) of PTH(1-34) (FIG. A) and Seq. ID No. 111 (FIG. B), as representative figure is shown in FIG. 1. The In vivo DRC study data, after 6-weeks treatment with Seq. ID. No. 111 ((AC$_3$C)-V-Aib-EIQ-(α-Me-2,6-F-Phe)-Nle-HQ-Har-Aib-K-(α-Me-2,6-F-Phe)), at different doses (0.1/0.2/0.3/0.5 mg/kg, po), in OVX Female Wister rats, via oral route of administration, as representative figure is shown as FIG. 3 (FIG. A: % increase in serum $Ca^{2+}$ levels; FIG. B: % decrease in serum $PO_4$ levels). The FIG. 4 represents the Changes in biochemical parameters and femur weight, in OVX Rat after 6 weeks treatment with Seq. ID No. 111 and PTH(1-34). The FIGS. 5, 6 and 7 represents histological sections of the femur, tibia and lumbar vertebrae, in OVX rats, after 6-weeks treatment with Seq. ID No. 111.

Utilities:

In a preferred embodiment, the present invention provides a method of making short chain peptides that function as an agonist of the PTH-1 receptor having different degree of affinity (1-1000 nM concentration) in UMR-106 cells. The PTH-1 receptor agonistic activity was assessed by estimation of amount of cAMP released by the test compounds (in vitro). In OVX mice/rat models (in vivo), some of the short-chain peptides showed improvement in bone growth parameter thus making them ideal therapeutic candidates for the treatment and prevention of osteoporosis.

Novel short chain peptides of present invention showed increased stability against various proteolytic enzymes and due to increased stability and short chain length, such short chain peptides can also be delivered by oral route of administration, along with other invensive and non-invensive routes of administration.

The novel short chain peptides of the present invention can be formulated into suitable pharmaceutically acceptable compositions by combining with suitable excipients as are well known.

The pharmaceutical composition is provided by employing conventional techniques. Preferably the composition is in unit dosage form containing an effective amount of the active component, that is, the short-chain peptides of formula (I) either alone or combination, according to this invention. The pharmaceutical composition can be prepared by known processes by combining the compound of formula (I) with suitable excipients comprising suitable excipients selected from suitable diluents, stabilizers, buffers and the like as is known in the art.

The quantity of active component, that is, the short chain peptides of formula (I) according to this invention, in the pharmaceutical composition and unit dosage form thereof may be varied or adjusted widely depending upon the particular application method, the potency of the particular short chain peptides and the desired concentration. Generally, the quantity of active component will range between 0.5% to 90% by weight of the composition.

Accordingly, the short chain peptides of the present invention can be administered to mammals, preferably humans, for the treatment of a variety of conditions and disorders, including, but not limited to, treating or preventing osteoporosis, such as primary osteoporosis, endocrine osteoporosis (hyperthyroidism, hyperparathyroidism, Cushing's syndrome, acromegaly, type 1 diabetes mellitus, adrenal insufficiency), hereditary and congenital forms of osteoporosis (osteogenesis imperfecta, homocystinuria, Menkes' syndrome and Riley-Day syndrome), nutritional and gastrointestinal disorders, haematological disorders/malignancy (multiple myeloma, lymphoma and leukaemia, hemophilia, thalassemia), osteoporosis due to immobilization, chronic obstructive pulmonary disease or rheumatologic disorders (rheumatoid arthritis, spondylitis), Osteomyelitis or an infectious lesion in bone, leading to bone loss.

Hypercalcemia resulting from solid tumours and hematologic malignancies, idiopathic hypercalcemia and hypercalcemia associated with hyperthyroidism and renal function disorders. Osteopenia following surgery induced by steroid administration and associated with disorders of the small and large intestine and with chronic hepatic and renal diseases. Osteonecrosis or bone cell death, associated with traumatic injury or nontraumatic necrosis associated with Gaucher's disease, sickle cell anaemia, systemic lupus erythematosus and other conditions. Periodontal bone loss, Osteolytic metastasis, bone fracture healing and hyperproliferative skin disorders such as psoriasis.

SEQUENCE LISTING (955 sequences)

SEQ ID NO: 1 - protein, 34 aa, Homo sapiens
SVSEIQLMHNLGKHLNSMERVEWLRKKLQDVHNF

SEQ ID NO: 2 - protein, 11 aa, Homo sapiens
SVSEIQLMHNL

SEQ ID NO: 3 - protein, 14 aa, Homo sapiens
SVSEIQLMHNLGKH

SEQ ID NO: 4 - protein, 15 aa, Homo sapiens
SVSEIQLMHNLGKHL

SEQ ID NO: 5 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (11)..(11): Modified residue at this position is Homoarginine (Har), which structurally mimics Arginine
  MISC_FEATURE (14)..(14): Modified residue at this position is alpha-methyl-phenylalanine (alpha-Me-Phe-), which structurally mimics Phenylalanine
AVAEIQLMHQRAKF

SEQ ID NO: 6 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-phenylalanine (alpha-Me-Phe-), which structurally mimics Phenylalanine
AVAEIQLMHQRAKF

SEQ ID NO: 7 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-phenylalanine (alpha-Me-Phe-), which structurally mimics Phenylalanine
AVAEIQLMHQRPKF

SEQ ID NO: 8 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-phenylalanine (alpha-Me-Phe-), which structurally mimics Phenylalanine
AVAEIQLMHQRPKF

SEQ ID NO: 9 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-phenylalanine (alpha-Me-Phe-), which structurally mimics Phenylalanine
AVAEIQLMHQRAKF

SEQ ID NO: 10 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-phenylalanine (alpha-Me-Phe-), which structurally mimics Phenylalanine
AVAEIQLMHQRAKF

SEQ ID NO: 11 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-phenylalanine (alpha-Me-Phe-), which structurally mimics Phenylalanine
AVAEIQLMHQRAKF

SEQ ID NO: 12 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-phenylalanine (alpha-Me-Phe-), which structurally mimics Phenylalanine
AVAEIQLMHQRPKF

SEQ ID NO: 13 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-phenylalanine (alpha-Me-Phe-), which structurally mimics Phenylalanine
AVAEIQLMHQRPKF

SEQ ID NO: 14 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-phenylalanine (alpha-Me-Phe-), which structurally mimics Phenylalanine
AVAEIQLMHQRAKF

SEQ ID NO: 15 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-phenylalanine (alpha-Me-Phe-), which structurally mimics Phenylalanine
AVAEIQLMHQRAKF

SEQ ID NO: 16 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-phenylalanine (alpha-Me-Phe-), which structurally mimics Phenylalanine
AVAEIQLMHQRAKF

SEQ ID NO: 17 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-phenylalanine (alpha-Me-Phe-), which structurally mimics Phenylalanine
AVAEIQLMHQRAKF

SEQ ID NO: 18 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-phenylalanine (alpha-Me-Phe-), which structurally mimics Phenylalanine
AVAEIQLMHQRPKF

SEQ ID NO: 19 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-phenylalanine (alpha-Me-Phe-), which structurally mimics Phenylalanine
AVAEIQLMHQRPKF

SEQ ID NO: 20 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-phenylalanine (alpha-Me-Phe-), which structurally mimics Phenylalanine
AVAEIQLMHQRAKF

SEQ ID NO: 21 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-phenylalanine (alpha-Me-Phe-), which structurally mimics Phenylalanine
AVAEIQLMHQRAKF

SEQ ID NO: 22 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclohexane carboxylic acid, which structurally mimics Alanine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-phenylalanine (alpha-Me-Phe-), which structurally mimics Phenylalanine
AVAEIQLMHQRAKF

SEQ ID NO: 23 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclohexane carboxylic acid, which structurally mimics Alanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-phenylalanine (alpha-Me-Phe-), which structurally mimics Phenylalanine
AVAEIQLMHQRAKF

SEQ ID NO: 24 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-phenylalanine (alpha-Me-Phe-), which structurally mimics Phenylalanine
AVAEIQFMHQRAKF

SEQ ID NO: 25 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-phenylalanine (alpha-Me-Phe-), which structurally mimics Phenylalanine
AVAEIQFMHQRPKF

SEQ ID NO: 26 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-phenylalanine (alpha-Me-Phe-), which structurally mimics Phenylalanine
AVAEIQFMHQRAKF

SEQ ID NO: 27 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-phenylalanine (alpha-Me-Phe-), which structurally mimics Phenylalanine
AVAEIQFMHQRAKF

SEQ ID NO: 28 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-phenylalanine (alpha-Me-Phe-), which structurally mimics Phenylalanine
AVAEIQFMHQRPKF

SEQ ID NO: 29 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-phenylalanine (alpha-Me-Phe-), which structurally mimics Phenylalanine
AVAEIQFMHQRAKF

SEQ ID NO: 30 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-phenylalanine (alpha-Me-Phe-), which structurally mimics Phenylalanine
AVAEIQFMHQRAKF

SEQ ID NO: 31 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-phenylalanine (alpha-Me-Phe-), which structurally mimics Phenylalanine
AVAEIQFMHQRPKF

SEQ ID NO: 32 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-phenylalanine (alpha-Me-Phe-), which structurally mimics Phenylalanine
AVAEIQFMHQRAKF

SEQ ID NO: 33 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-phenylalanine (alpha-Me-Phe-), which structurally mimics Phenylalanine
AVAEIQFMHQRAKF

SEQ ID NO: 34 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-phenylalanine (alpha-Me-Phe-), which structurally mimics Phenylalanine
AVAEIQFMHQRPKF

SEQ ID NO: 35 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-phenylalanine (alpha-Me-Phe-), which structurally mimics Phenylalanine
AVAEIQFMHQRAKF

SEQ ID NO: 36 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-phenylalanine (alpha-Me-Phe-), which structurally mimics Phenylalanine
AVAEIQFMHQRAKF

SEQ ID NO: 37 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-phenylalanine (alpha-Me-Phe-), which structurally mimics Phenylalanine
AVAEIQFMHQRPKF

SEQ ID NO: 38 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-phenylalanine (alpha-Me-Phe-), which structurally mimics Phenylalanine
AVAEIQFMHQRAKF

SEQ ID NO: 39 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-phenylalanine (alpha-Me-Phe-), which structurally mimics Phenylalanine
AVAEIQFMHQRAKF

SEQ ID NO: 40 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-phenylalanine (alpha-Me-Phe-), which structurally mimics Phenylalanine
AVAEIQFMHQRPKF

SEQ ID NO: 41 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-phenylalanine (alpha-Me-Phe-), which structurally mimics Phenylalanine
AVAEIQFMHQRAKF

SEQ ID NO: 42 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-phenylalanine (alpha-Me-Phe-), which structurally mimics Phenylalanine
AVAEIQFMHQRAKF

SEQ ID NO: 43 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-phenylalanine (alpha-Me-Phe-), which structurally mimics Phenylalanine
AVAEIQFMHQRPKF

SEQ ID NO: 44 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(114): Modified residue at this position is alpha-methyl-phenylalanine (alpha-Me-Phe-), which structurally mimics Phenylalanine
AVAEIQFMHQRAKF

SEQ ID NO: 45 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-phenylalanine (alpha-Me-Phe-), which structurally mimics Phenylalanine
AVAEIQFMHQRAKF

SEQ ID NO: 46 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-phenylalanine (alpha-Me-Phe-), which structurally mimics Phenylalanine
AVAEIQFMHQRPKF

SEQ ID NO: 47 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-phenylalanine (alpha-Me-Phe-), which structurally mimics Phenylalanine
AVAEIQFMHQRAKF

SEQ ID NO: 48 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (10)..(10): Modified residue at this position is 2-amino-4-cyanobutanoic acid (Abu (CN)), which structurally mimics Arginine
  MISC_FEATURE (11)..(11): Modified residue at this position is Homoarginine (Har), which structurally mimics Arginine
  MISC_FEATURE (14)..(14): Modified residue at this position is alpha-methyl-phenylalanine (alpha-Me-Phe-), which structurally mimics Phenylalanine
AVAEIQFMHRRAKF

SEQ ID NO: 49 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-phenylalanine (alpha-Me-Phe-), which structurally mimics Phenylalanine
AVAEIQFMHQRAKF

SEQ ID NO: 50 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-phenylalanine (alpha-Me-Phe-), which structurally mimics Phenylalanine
AVAEIQFMHQRPKF

SEQ ID NO: 51 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-phenylalanine (alpha-Me-Phe-), which structurally mimics Phenylalanine
AVAEIQFMHQRAKF

SEQ ID NO: 52 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (11)..(11): Modified residue at this position is Homoarginine (Har), which structurally mimics Arginine
  MISC_FEATURE (14)..(14): Modified residue at this position is alpha-methyl-phenylalanine (alpha-Me-Phe-), which structurally mimics Phenylalanine
AVAEIQFMHQRAKF

SEQ ID NO: 53 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-phenylalanine (alpha-Me-Phe-), which structurally mimics Phenylalanine
AVAEIQFMHQRPKF

SEQ ID NO: 54 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-phenylalanine (alpha-Me-Phe-), which structurally mimics Phenylalanine
AVAEIQFMHQRAKF

SEQ ID NO: 55 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRAKF

SEQ ID NO: 56 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-phenylalanine (alpha-Me-Phe-), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRPKF

SEQ ID NO: 57 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAKF

SEQ ID NO: 58 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRAKF

SEQ ID NO: 59 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-2F-phenylalanine (alpha-Me-2F-Phe), which structurally mimics Phenylalanine
AVAEIQFMHQRPKF

SEQ ID NO: 60 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAKF

SEQ ID NO: 61 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRAKF

SEQ ID NO: 62 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-2F-phenylalanine (alpha-Me-2F-Phe), which structurally mimics Phenylalanine
AVAEIQFMHQRPKF

SEQ ID NO: 63 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAKF

SEQ ID NO: 64 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRAKF

SEQ ID NO: 65 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-2F-phenylalanine (alpha-Me-2F-Phe), which structurally mimics Phenylalanine
AVAEIQFMHQRPKF

SEQ ID NO: 66 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAKF

SEQ ID NO: 67 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRAKF

SEQ ID NO: 68 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-2F-phenylalanine (alpha-Me-2F-Phe), which structurally mimics Phenylalanine
AVAEIQFMHQRPKF

SEQ ID NO: 69 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAKF

SEQ ID NO: 70 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Lysine Biotin (K (Biotin)), which structurally mimics Lysine
  MISC_FEATURE (14)..(14): Modified residue at this position is alpha-methyl-2F-phenylalanine (alpha-Me-2F-Phe), which structurally mimics Phenylalanine
AVAEIQFMHQRAKF

SEQ ID NO: 71 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRAKF

SEQ ID NO: 72 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-2F-phenylalanine (alpha-Me-2F-Phe), which structurally mimics Phenylalanine
AVAEIQFMHQRPKF

SEQ ID NO: 73 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAKF

SEQ ID NO: 74 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRAKF

SEQ ID NO: 75 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-2F-phenylalanine (alpha-Me-2F-Phe), which structurally mimics Phenylalanine
AVAEIQFMHQRPKF

SEQ ID NO: 76 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAKF

SEQ ID NO: 77 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRAKF

SEQ ID NO: 78 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-2F-phenylalanine (alpha-Me-2F-Phe), which structurally mimics Phenylalanine
AVAEIQFMHQRPKF

SEQ ID NO: 79 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAKF

SEQ ID NO: 80 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRAKF

SEQ ID NO: 81 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-2F-phenylalanine (alpha-Me-2F-Phe), which structurally mimics Phenylalanine
AVAEIQFMHQRPKF

SEQ ID NO: 82 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAKF

SEQ ID NO: 83 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRAKF

SEQ ID NO: 84 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-2F-phenylalanine (alpha-Me-2F-Phe), which structurally mimics Phenylalanine
AVAEIQFMHQRPKF

SEQ ID NO: 85 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAKF

SEQ ID NO: 86 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (10)..(10): Modified residue at this position is 2-amino-4-cyanobutanoic acid (Abu (CN)), which structurally mimics Arginine
  MISC_FEATURE (11)..(11): Modified residue at this position is Homoarginine (Har), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHRRAKF

SEQ ID NO: 87 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclohexane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRAKF

SEQ ID NO: 88 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclohexane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-2F-phenylalanine (alpha-Me-2F-Phe), which structurally mimics Phenylalanine
AVAEIQFMHQRPKF

SEQ ID NO: 89 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclohexane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAKF

SEQ ID NO: 90 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAKF

SEQ ID NO: 91 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRPKF

SEQ ID NO: 92 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAKF

SEQ ID NO: 93 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAKF

SEQ ID NO: 94 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRPKF

SEQ ID NO: 95 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAKF

SEQ ID NO: 96 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAKF

SEQ ID NO: 97 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRPKF

SEQ ID NO: 98 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAKF

SEQ ID NO: 99 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAKF

SEQ ID NO: 100 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRPKF

SEQ ID NO: 101 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAKF

SEQ ID NO: 102 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAKF

SEQ ID NO: 103 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRPKF

SEQ ID NO: 104 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAKF

SEQ ID NO: 105 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is Lysine Biotin (K (Biotin)), which structurally mimics Lysine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAKF

SEQ ID NO: 106 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAKF

SEQ ID NO: 107 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRPKF

SEQ ID NO: 108 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAKF

SEQ ID NO: 109 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAKF

SEQ ID NO: 110 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRPKF

SEQ ID NO: 111 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAKF

SEQ ID NO: 112 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRAKF

SEQ ID NO: 113 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRPKF

SEQ ID NO: 114 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAKF

SEQ ID NO: 115 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAKF

SEQ ID NO: 116 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRPKF

SEQ ID NO: 117 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAKF

SEQ ID NO: 118 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAKF

SEQ ID NO: 119 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRPKF

SEQ ID NO: 120 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclohexane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAKF

SEQ ID NO: 121 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 122 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-phenylalanine (alpha-Me-Phe-), which structurally mimics Phenylalanine
AVAEIQFMHQRARF

SEQ ID NO: 123 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 124 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 125 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 126 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 127 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 128 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 129 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 130 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 131 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 132 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 133 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 134 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 135 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 136 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 137 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 138 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 139 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 140 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 141 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 142 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 143 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 144 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 145 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (10)..(10): Modified residue at this position is 2-amino-4-cyanobutanoic acid (Abu (CN)), which structurally mimics Arginine
  MISC_FEATURE (11)..(11): Modified residue at this position is Homoarginine (Har), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 146 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 147 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 148 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 149 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 150 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 151 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 152 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 153 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is -alpha-methyl proline (alpha-Me-Pro), which structurally mimics Proline
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 154 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 155 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 156 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 157 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 158 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 159 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 160 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 161 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 162 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 163 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 164 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 165 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 166 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 167 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 168 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 169 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 170 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 171 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 172 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 173 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 174 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 175 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 176 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 177 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 178 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 179 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 180 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 181 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 182 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 183 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 184 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 185 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 186 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 187 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 188 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 189 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 190 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 191 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 192 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 193 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 194 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 195 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 196 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 197 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 198 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 199 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 200 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 201 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 202 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 203 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 204 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 205 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 206 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 207 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 208 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 209 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 210 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 211 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 212 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 213 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 214 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 215 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 216 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 217 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 218 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 219 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 220 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 221 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 222 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 223 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 224 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 225 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 226 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 227 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 228 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 229 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 230 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 231 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 232 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 233 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 234 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 235 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 236 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 237 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 238 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 239 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 240 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 241 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 242 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 243 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 244 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 245 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 246 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 247 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 248 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 249 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 250 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 251 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 252 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 253 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 254 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 255 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 256 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 257 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 258 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 259 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 260 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 261 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 262 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 263 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 264 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 265 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 266 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 267 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 268 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 269 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 270 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 271 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 272 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 273 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 274 - protein, 14 aa, Artificial
  This short-chain peptide was synthetically generated and prepared
  MISC_FEATURE (1)..(1): Modified residue at this position is Amino cyclopropane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 275 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 276 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 277 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 278 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 279 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 280 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Homoarginine (Har), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 281 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 282 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 283 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 284 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 285 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 286 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 287 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 288 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 289 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 290 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 291 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 292 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 293 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 294 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 295 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 296 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 297 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 298 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 299 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 300 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 301 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 302 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 303 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 304 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 305 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 306 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 307 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 308 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 309 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 310 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 311 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 312 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 313 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 314 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 315 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 316 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 317 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 318 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 319 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 320 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 321 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 322 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 323 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 324 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 325 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 326 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 327 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 328 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 329 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 330 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 331 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 332 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 333 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 334 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 335 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 336 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 337 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 338 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 339 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 340 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 341 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 342 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 343 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 344 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Ornithine (Orn), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 345 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 346 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 347 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 348 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 349 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 350 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 351 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 352 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 353 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 354 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 355 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 356 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 357 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 358 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 359 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 360 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Citrulline (Cit), which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 361 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 362 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 363 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 364 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 365 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 366 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 367 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 368 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2F-phenylalanine (alpha-Me-2F-Phe), which structurally mimics Phenylalanine
AVAEIQFMHQRAAF

SEQ ID NO: 369 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 370 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 371 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 372 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 373 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 374 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 375 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 376 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-amino isobutyric acid (Aib), which structurally mimics Alanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAAF

SEQ ID NO: 377 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 378 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 379 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 380 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 381 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 382 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 383 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 384 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2F-phenylalanine (alpha-Me-2F-Phe), which structurally mimics Phenylalanine
AVAEIQFMHQRAFF

SEQ ID NO: 385 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 386 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 387 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 388 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 389 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 390 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 391 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 392 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is alpha-methyl-2,6-F-phenylalanine (alpha-Me-2,6-F-Phe), which structurally mimics Phenylalanine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRAFF

SEQ ID NO: 393 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 394 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 395 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is Amino cyclopentane carboxylic acid, which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 396 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 397 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 398 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 399 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 400 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2F-phenylalanine (alpha-Me-2F-Phe), which structurally mimics Phenylalanine
AVAEIQFMHQRARF

SEQ ID NO: 401 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 402 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 403 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 404 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2F-phenylalanine (alpha-Me-2F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 405 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 406 - protein, 14 aa, Artificial
  This short-chain peptide was synthetically generated and prepared
  MISC_FEATURE (1)..(1): Modified residue at this position is alpha-amino isobutyric acid (Aib), which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 407 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 408 - protein, 14 aa, Artificial
  This short-chain peptide was synthetically generated and prepared
  MISC_FEATURE (1)..(1): Modified residue at this position is Amino cyclopentane carboxylic acid, which structurally mimics Alanine
  MISC_FEATURE (3)..(3): Modified residue at this position is alpha-amino isobutyric acid (Aib), which structurally mimics Alanine
  MISC_FEATURE (7)..(7): Modified residue at this position is alpha-methyl-2,6-F-phenylalanine (alpha-Me-2,6-F-Phe), which structurally mimics Phenylalanine
  MISC_FEATURE (8)..(8): Modified residue at this position is Norleucine (Nle), which structurally mimics Methionine
  MISC_FEATURE (11)..(11): Modified residue at this position is Citrulline (Cit), which structurally mimics Arginine
  MISC_FEATURE (12)..(12): Modified residue at this position is alpha-amino isobutyric acid (Aib), which structurally mimics Alanine
  MISC_FEATURE (13)..(13): Modified residue at this position is Arginine(Nitro) (Arg(NO2)) , which structurally mimics Arginine
  MISC_FEATURE (14)..(14): Modified residue at this position is alpha-methyl-2,6-F-phenylalanine (alpha-Me-2,6-F-Phe), which structurally mimics Phenylalanine
AVAEIQFMHQRARF

SEQ ID NO: 409 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQRARF

SEQ ID NO: 410 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQRARF

SEQ ID NO: 411 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQRARF

SEQ ID NO: 412 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQRARF

SEQ ID NO: 413 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQRARF

SEQ ID NO: 414 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position is -Homo Citrulline which structurally mimics Arginine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQRARF

SEQ ID NO: 415 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQRARF

SEQ ID NO: 416 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position is -Homo Citrulline which structurally mimics Arginine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQRARF

SEQ ID NO: 417 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQRARF

SEQ ID NO: 418 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQRARF

SEQ ID NO: 419 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQRARF

SEQ ID NO: 420 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQRARF

SEQ ID NO: 421 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position mimics -alpha amino-isobutyric acid (Aib) which structurally mimics Alanine.
  MISC_FEATURE (13)..(13): Modified residue at this position is Citrulline which structurally mimics Arginine
  MISC_FEATURE (14)..(14): Modified residue at this position is -alpha methyl phenylalanine which structurally mimics Phenylalanine.
AVAEIQFMHQRARF

SEQ ID NO: 422 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQRARF

SEQ ID NO: 423 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQRARF

SEQ ID NO: 424 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQRARF

SEQ ID NO: 425 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQRAAF

SEQ ID NO: 426 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQRAAF

SEQ ID NO: 427 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQRAAF

SEQ ID NO: 428 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQRAAF

SEQ ID NO: 429 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQRAAF

SEQ ID NO: 430 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQRAAF

SEQ ID NO: 431 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQRAAF

SEQ ID NO: 432 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQRAAF

SEQ ID NO: 433 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQRAAF

SEQ ID NO: 434 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQRAAF

SEQ ID NO: 435 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQRAAF

SEQ ID NO: 436 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQRAAF

SEQ ID NO: 437 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQRAAF

SEQ ID NO: 438 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQRAAF

SEQ ID NO: 439 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQRAAF

SEQ ID NO: 440 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQRAAF

SEQ ID NO: 441 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQRAFF

SEQ ID NO: 442 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQRAFF

SEQ ID NO: 443 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQRAFF

SEQ ID NO: 444 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQRAFF

SEQ ID NO: 445 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQRAFF

SEQ ID NO: 446 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQRAFF

SEQ ID NO: 447 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQRAFF

SEQ ID NO: 448 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQRAFF

SEQ ID NO: 449 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQRAFF

SEQ ID NO: 450 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQRAFF

SEQ ID NO: 451 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQRAFF

SEQ ID NO: 452 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQRAFF

SEQ ID NO: 453 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQRAFF

SEQ ID NO: 454 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQRAFF

SEQ ID NO: 455 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQRAFF

SEQ ID NO: 456 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQRAFF

SEQ ID NO: 457 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQRARF

SEQ ID NO: 458 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQRARF

SEQ ID NO: 459 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQRARF

SEQ ID NO: 460 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQRARF

SEQ ID NO: 461 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQRARF

SEQ ID NO: 462 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQRARF

SEQ ID NO: 463 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQRARF

SEQ ID NO: 464 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQRARF

SEQ ID NO: 465 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQRARF

SEQ ID NO: 466 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQRARF

SEQ ID NO: 467 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQRARF

SEQ ID NO: 468 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQRARF

SEQ ID NO: 469 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQRARF

SEQ ID NO: 470 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQRARF

SEQ ID NO: 471 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQRARF

SEQ ID NO: 472 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQRARF

SEQ ID NO: 473 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQFARF

SEQ ID NO: 474 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQFARF

SEQ ID NO: 475 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQFARF

SEQ ID NO: 476 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQFARF

SEQ ID NO: 477 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQFARF

SEQ ID NO: 478 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQFARF

SEQ ID NO: 479 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQFARF

SEQ ID NO: 480 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQFARF

SEQ ID NO: 481 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQFARF

SEQ ID NO: 482 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQFARF

SEQ ID NO: 483 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQFARF

SEQ ID NO: 484 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQFARF

SEQ ID NO: 485 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQFARF

SEQ ID NO: 486 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQFARF

SEQ ID NO: 487 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQFARF

SEQ ID NO: 488 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQFARF

SEQ ID NO: 489 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQFAAF

SEQ ID NO: 490 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQFAAF

SEQ ID NO: 491 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQFAAF

SEQ ID NO: 492 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQFAAF

SEQ ID NO: 493 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQFAAF

SEQ ID NO: 494 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQFAAF

SEQ ID NO: 495 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQFAAF

SEQ ID NO: 496 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQFAAF

SEQ ID NO: 497 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQFAAF

SEQ ID NO: 498 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQFAAF

SEQ ID NO: 499 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQFAAF

SEQ ID NO: 500 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQFAAF

SEQ ID NO: 501 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQFAAF

SEQ ID NO: 502 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQFAAF

SEQ ID NO: 503 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQFAAF

SEQ ID NO: 504 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQFAAF

SEQ ID NO: 505 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQFAFF

SEQ ID NO: 506 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQFAFF

SEQ ID NO: 507 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQFAFF

SEQ ID NO: 508 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQFAFF

SEQ ID NO: 509 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQFAFF

SEQ ID NO: 510 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQFAFF

SEQ ID NO: 511 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQFAFF

SEQ ID NO: 512 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQFAFF

SEQ ID NO: 513 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQFAFF

SEQ ID NO: 514 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQFAFF

SEQ ID NO: 515 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQFAFF

SEQ ID NO: 516 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQFAFF

SEQ ID NO: 517 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQFAFF

SEQ ID NO: 518 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQFAFF

SEQ ID NO: 519 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQFAFF

SEQ ID NO: 520 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQFAFF

SEQ ID NO: 521 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQFARF

SEQ ID NO: 522 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQFARF

SEQ ID NO: 523 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQFARF

SEQ ID NO: 524 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQFARF

SEQ ID NO: 525 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQFARF

SEQ ID NO: 526 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQFARF

SEQ ID NO: 527 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQFARF

SEQ ID NO: 528 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQFARF

SEQ ID NO: 529 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQFARF

SEQ ID NO: 530 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQFARF

SEQ ID NO: 531 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQFARF

SEQ ID NO: 532 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQFARF

SEQ ID NO: 533 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQFARF

SEQ ID NO: 534 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQFARF

SEQ ID NO: 535 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQFARF

SEQ ID NO: 536 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -alpha methyl phenylalanine which structurally mimics Phenylalanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQFARF

SEQ ID NO: 537 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQAARF

SEQ ID NO: 538 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQAARF

SEQ ID NO: 539 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQAARF

SEQ ID NO: 540 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQAARF

SEQ ID NO: 541 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQAARF

SEQ ID NO: 542 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQAARF

SEQ ID NO: 543 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQAARF

SEQ ID NO: 544 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQAARF

SEQ ID NO: 545 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQAARF

SEQ ID NO: 546 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQAARF

SEQ ID NO: 547 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQAARF

SEQ ID NO: 548 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQAARF

SEQ ID NO: 549 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQAARF

SEQ ID NO: 550 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQAARF

SEQ ID NO: 551 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQAARF

SEQ ID NO: 552 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQFMHQAARF

SEQ ID NO: 553 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQAAAF

SEQ ID NO: 554 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQAAAF

SEQ ID NO: 555 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQAAAF

SEQ ID NO: 556 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQAAAF

SEQ ID NO: 557 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQAAAF

SEQ ID NO: 558 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQAAAF

SEQ ID NO: 559 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQAAAF

SEQ ID NO: 560 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQAAAF

SEQ ID NO: 561 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQAAAF

SEQ ID NO: 562 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQAAAF

SEQ ID NO: 563 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQAAAF

SEQ ID NO: 564 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQAAAF

SEQ ID NO: 565 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQAAAF

SEQ ID NO: 566 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQAAAF

SEQ ID NO: 567 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQAAAF

SEQ ID NO: 568 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position mimics -alpha amino-isobutyric acid (Aib) which structurally mimics Alanine.
  MISC_FEATURE (14)..(14): Modified residue at this position is -alpha methyl phenylalanine which structurally mimics Phenylalanine.
AVAEIQFMHQAAAF

SEQ ID NO: 569 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQAAFF

SEQ ID NO: 570 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQAAFF

SEQ ID NO: 571 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQAAFF

SEQ ID NO: 572 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQAAFF

SEQ ID NO: 573 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQAAFF

SEQ ID NO: 574 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQAAFF

SEQ ID NO: 575 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQAAFF

SEQ ID NO: 576 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQAAFF

SEQ ID NO: 577 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQAAFF

SEQ ID NO: 578 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQAAFF

SEQ ID NO: 579 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQAAFF

SEQ ID NO: 580 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQAAFF

SEQ ID NO: 581 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQAAFF

SEQ ID NO: 582 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQAAFF

SEQ ID NO: 583 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQAAFF

SEQ ID NO: 584 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is -alpha methyl phenylalanine which structurally mimics Phenylalanine.
  MISC_FEATURE (14)..(14): Modified residue at this position is -alpha methyl phenylalanine which structurally mimics Phenylalanine.
AVAEIQFMHQAAFF

SEQ ID NO: 585 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQAARF

SEQ ID NO: 586 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQAARF

SEQ ID NO: 587 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQAARF

SEQ ID NO: 588 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQAARF

SEQ ID NO: 589 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQAARF

SEQ ID NO: 590 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQAARF

SEQ ID NO: 591 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQAARF

SEQ ID NO: 592 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQAARF

SEQ ID NO: 593 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQAARF

SEQ ID NO: 594 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQAARF

SEQ ID NO: 595 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQAARF

SEQ ID NO: 596 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQAARF

SEQ ID NO: 597 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQAARF

SEQ ID NO: 598 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQAARF

SEQ ID NO: 599 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQAARF

SEQ ID NO: 600 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position mimics -alpha amino-isobutyric acid (Aib) which structurally mimics Alanine.
  MISC_FEATURE (12)..(12): Modified residue at this position mimics -alpha amino-isobutyric acid (Aib) which structurally mimics Alanine.
  MISC_FEATURE (13)..(13): Modified residue at this position is arginine (NO2) which structurally mimics with Arginine.
  MISC_FEATURE (14)..(14): Modified residue at this position is -alpha methyl phenylalanine which structurally mimics Phenylalanine.
AVAEIQFMHQAARF

SEQ ID NO: 601 - protein, 15 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (11)..(11): Modified residue at this position is -Homo Arginine which structurally mimics Arginine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 602 - protein, 15 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (8)..(8): Modified residue at this position is -Norleucine which structurally mimics Methionine.
  MISC_FEATURE (11)..(11): Modified residue at this position is -Homo Arginine which structurally mimics Arginine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 603 - protein, 15 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (11)..(11): Modified residue at this position is -Homo Arginine which structurally mimics Arginine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 604 - protein, 15 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (8)..(8): Modified residue at this position is -Norleucine which structurally mimics Methionine.
  MISC_FEATURE (11)..(11): Modified residue at this position is -Homo Arginine which structurally mimics Arginine.
  MISC_FEATURE (14)..(14): Modified residue at this position is 2'-Ethyl-4'-methoxy-biphenylalanine which structurally mimics with Phenylalanine.
  MISC_FEATURE (15)..(15): APPA: Modified residue at this position is 2-Amino-5-phenylpentanoic acid which structurally mimics with phenylalanine.
AVAEIQLMHQRAKFF

SEQ ID NO: 605 - protein, 15 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (11)..(11): Modified residue at this position is -Homo Arginine which structurally mimics Arginine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 606 - protein, 15 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (8)..(8): Modified residue at this position is -Norleucine which structurally mimics Methionine.
  MISC_FEATURE (11)..(11): Modified residue at this position is -Homo Arginine which structurally mimics Arginine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 607 - protein, 15 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position is amino cyclo-pentane carboxylic acid which structurally mimics Alanine.
  MISC_FEATURE (11)..(11): Modified residue at this position is -Homo Arginine which structurally mimics Arginine.
  MISC_FEATURE (14)..(14): Modified residue at this position is 2'-Ethyl-4'-methoxy-biphenylalanine which structurally mimics with Phenylalanine.
  MISC_FEATURE (15)..(15): APPA: Modified residue at this position is 2-Amino-5-phenylpentanoic acid which structurally mimics with phenylalanine.
AVAEIQLMHQRAKFF

SEQ ID NO: 608 - protein, 15 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position is amino cyclo-pentane carboxylic acid which structurally mimics Alanine.
  MISC_FEATURE (8)..(8): Modified residue at this position is -Norleucine which structurally mimics Methionine.
  MISC_FEATURE (11)..(11): Modified residue at this position is -Homo Arginine which structurally mimics Arginine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 609 - protein, 15 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (11)..(11): Modified residue at this position is -Homo Arginine which structurally mimics Arginine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 610 - protein, 15 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position is -amino cyclo-pentane carboxylic acid which structurally mimics Alanine.
  MISC_FEATURE (8)..(8): Modified residue at this position is -Norleucine which structurally mimics Methionine.
  MISC_FEATURE (11)..(11): Modified residue at this position is -Homo Arginine which structurally mimics Arginine.
  MISC_FEATURE (14)..(14): Modified residue at this position is 2'-Ethyl-4'-methoxy-biphenylalanine which structurally mimics with Phenylalanine.
  MISC_FEATURE (15)..(15): APPA: Modified residue at this position is 2-Amino-5-phenylpentanoic acid which structurally mimics with phenylalanine.
AVAEIQLMHQRAKFF

SEQ ID NO: 611 - protein, 15 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position is -amino cyclo-pentane carboxylic acid which structurally mimics Alanine.
  MISC_FEATURE (11)..(11): Modified residue at this position is -Homo Arginine which structurally mimics Arginine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 612 - protein, 15 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position is amino cyclo-pentane carboxylic acid which structurally mimics Alanine.
  MISC_FEATURE (8)..(8): Modified residue at this position is -Norleucine which structurally mimics Methionine.
  MISC_FEATURE (11)..(11): Modified residue at this position is -Homo Arginine which structurally mimics Arginine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 613 - protein, 15 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (11)..(11): Modified residue at this position is -Homo Arginine which structurally mimics Arginine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 614 - protein, 15 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (8)..(8): Modified residue at this position is -Norleucine which structurally mimics Methionine.
  MISC_FEATURE (11)..(11): Modified residue at this position is homoarginine(NO2) which structurally mimics with Arginine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 615 - protein, 15 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (11)..(11): Modified residue at this position is homoarginine(NO2) which structurally mimics with Arginine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 616 - protein, 15 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (8)..(8): Modified residue at this position is -Norleucine which structurally mimics Methionine.
  MISC_FEATURE (11)..(11): Modified residue at this position is homoarginine(NO2) which structurally mimics with Arginine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 617 - protein, 15 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (11)..(11): Modified residue at this position is homoarginine(NO2) which structurally mimics with Arginine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 618 - protein, 15 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (8)..(8): Modified residue at this position is -Norleucine which structurally mimics Methionine.
  MISC_FEATURE (11)..(11): Modified residue at this position is homoarginine(NO2) which structurally mimics with Arginine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 619 - protein, 15 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position is amino cyclo-pentane carboxylic acid which structurally mimics Alanine.
  MISC_FEATURE (11)..(11): Modified residue at this position is homoarginine(NO2) which structurally mimics with Arginine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 620 - protein, 15 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position is -amino cyclo-pentane carboxylic acid which structurally mimics Alanine.
  MISC_FEATURE (8)..(8): Modified residue at this position is -Norleucine which structurally mimics Methionine.
  MISC_FEATURE (11)..(11): Modified residue at this position is homoarginine(NO2) which structurally mimics with Arginine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 621 - protein, 15 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (11)..(11): Modified residue at this position is homoarginine(NO2) which structurally mimics with Arginine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 622 - protein, 15 aa, Artificial
  This short chain peptide was synthetically generated and prepared
  MISC_FEATURE (1)..(1): Modified residue at this position is 2-Amino-5-phenylpentanoic acid which structurally mimics with phenylalanine.
  MISC_FEATURE (3)..(3): Modified residue at this position is amino cyclo-pentane carboxylic acid which structurally mimics Alanine.
  MISC_FEATURE (8)..(8): Modified residue at this position is -Norleucine which structurally mimics Methionine.
  MISC_FEATURE (11)..(11): Modified residue at this position is homoarginine(NO2) which structurally mimics with Arginine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is -alpha methyl phenylalanine which structurally mimics Phenylalanine.
AVAEIQLMHQRAKFF

SEQ ID NO: 623 - protein, 15 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position is amino cyclo-pentane carboxylic acid which structurally mimics Alanine.
  MISC_FEATURE (11)..(11): Modified residue at this position is homoarginine(NO2) which structurally mimics with Arginine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 624 - protein, 15 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position is -amino cyclo-pentane carboxylic acid which structurally mimics Alanine.
  MISC_FEATURE (8)..(8): Modified residue at this position is -Norleucine which structurally mimics Methionine.
  MISC_FEATURE (11)..(11): Modified residue at this position is homoarginine(NO2) which structurally mimics with Arginine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 625 - protein, 15 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (11)..(11): Modified residue at this position is homoarginine(NO2) which structurally mimics with Arginine.
  MISC_FEATURE (13)..(13): Modified residue at this position is Lysine Biotin which structurally mimics with Lysine
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 626 - protein, 15 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (8)..(8): Modified residue at this position is -Norleucine which structurally mimics Methionine.
  MISC_FEATURE (11)..(11): Modified residue at this position is homoarginine(NO2) which structurally mimics with Arginine.
  MISC_FEATURE (13)..(13): Modified residue at this position is Lysine Biotin which structurally mimics with Lysine
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 627 - protein, 15 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (11)..(11): Modified residue at this position is -Homo Arginine which structurally mimics Arginine.
  MISC_FEATURE (13)..(13): Modified residue at this position is Lysine Biotin which structurally mimics with Lysine
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 628 - protein, 15 aa, Artificial
  This short chain peptide was synthetically generated and prepared
  MISC_FEATURE (3)..(3): Modified residue at this position mimics -alpha amino-isobutyric acid (Aib) which structurally mimics Alanine.
  MISC_FEATURE (8)..(8): Modified residue at this position is -Norleucine which structurally mimics Methionine.
  MISC_FEATURE (11)..(11): Modified residue at this position is -Homo Arginine which structurally mimics Arginine.
  MISC_FEATURE (13)..(13): Modified residue at this position is Lysine Biotin which structurally mimics with Lysine
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 629 - protein, 15 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (11)..(11): Modified residue at this position is homoarginine(NO2) which structurally mimics with Arginine.
  MISC_FEATURE (13)..(13): Modified residue at this position is alkylated lysine K(CO(CH2)6-CH3) which structurally mimics with Lysine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 630 - protein, 15 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (8)..(8): Modified residue at this position is -Norleucine which structurally mimics Methionine.
  MISC_FEATURE (11)..(11): Modified residue at this position is homoarginine(NO2) which structurally mimics with Arginine.
  MISC_FEATURE (13)..(13): Modified residue at this position is alkylated lysine K(CO(CH2)6-CH3) which structurally mimics with Lysine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 631 - protein, 15 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (11)..(11): Modified residue at this position is -Homo arginine which structurally mimics Arginine.
  MISC_FEATURE (13)..(13): Modified residue at this position is 2'-Ethyl-4'-methoxy-biphenylalanine which structurally mimics with Phenylalanine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 632 - protein, 15 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (8)..(8): Modified residue at this position is -Norleucine which structurally mimics Methionine.
  MISC_FEATURE (11)..(11): Modified residue at this position is -Homo arginine which structurally mimics Arginine.
  MISC_FEATURE (13)..(13): Modified residue at this position is alkylated lysine K(CO(CH2)6-CH3) which structurally mimics with Lysine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 633 - protein, 15 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (11)..(11): Modified residue at this position is homoarginine(NO2) which structurally mimics with Arginine.
  MISC_FEATURE (13)..(13): Modified residue at this position is alkylated lysine K(CO(CH2)6-CH3) which structurally mimics with Lysine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 634 - protein, 15 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (8)..(8): Modified residue at this position is -Norleucine which structurally mimics Methionine.
  MISC_FEATURE (11)..(11): Modified residue at this position is homoarginine(NO2) which structurally mimics with Arginine.
  MISC_FEATURE (13)..(13): Modified residue at this position is alkylated lysine K(CO(CH2)6-CH3) which structurally mimics with Lysine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 635 - protein, 15 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (11)..(11): Modified residue at this position is -Homo arginine which structurally mimics Arginine.
  MISC_FEATURE (13)..(13): Modified residue at this position is alkylated lysine K(CO(CH2)6-CH3) which structurally mimics with Lysine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 636 - protein, 15 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (8)..(8): Modified residue at this position is -Norleucine which structurally mimics Methionine.
  MISC_FEATURE (11)..(11): Modified residue at this position is -Homo arginine which structurally mimics Arginine.
  MISC_FEATURE (13)..(13): Modified residue at this position is alkylated lysine K(CO(CH2)6-CH3) which structurally mimics with Lysine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 637 - protein, 15 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position is -amino cyclo-pentane carboxylic acid which structurally mimics Alanine.
  MISC_FEATURE (8)..(8): Modified residue at this position is -Norleucine which structurally mimics Methionine.
  MISC_FEATURE (11)..(11): Modified residue at this position is -Homo arginine which structurally mimics Arginine.
  MISC_FEATURE (13)..(13): Modified residue at this position is alkylated lysine K(CO(CH2)6-CH3) which structurally mimics with Lysine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 638 - protein, 15 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position is -amino cyclo-pentane carboxylic acid which structurally mimics Alanine.
  MISC_FEATURE (11)..(11): Modified residue at this position is homoarginine(NO2) which structurally mimics with Arginine.
  MISC_FEATURE (13)..(13): Modified residue at this position N-methyl Lysine which structurally mimics with Lysine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 639 - protein, 15 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position is -amino cyclo-pentane carboxylic acid which structurally mimics Alanine.
  MISC_FEATURE (8)..(8): Modified residue at this position is -Norleucine which structurally mimics Methionine.
  MISC_FEATURE (11)..(11): Modified residue at this position is homoarginine(NO2) which structurally mimics with Arginine.
  MISC_FEATURE (13)..(13): Modified residue at this position N-methyl Lysine which structurally mimics with Lysine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 640 - protein, 15 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position is amino cyclo-pentane carboxylic acid which structurally mimics Alanine.
  MISC_FEATURE (8)..(8): Modified residue at this position is -Norleucine which structurally mimics Methionine.
  MISC_FEATURE (11)..(11): Modified residue at this position is -Homo arginine which structurally mimics Arginine.
  MISC_FEATURE (13)..(13): Modified residue at this position is alkylated lysine K(CO(CH2)6-CH3) which structurally mimics with Lysine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 641 - protein, 15 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position is amino cyclo-pentane carboxylic acid which structurally mimics Alanine.
  MISC_FEATURE (8)..(8): Modified residue at this position is N-methyl Norleucine which structurally mimics with methionine.
  MISC_FEATURE (11)..(11): Modified residue at this position is -Homo arginine which structurally mimics Arginine.
  MISC_FEATURE (13)..(13): Modified residue at this position is alkylated lysine K(CO(CH2)6-CH3) which structurally mimics with Lysine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 642 - protein, 15 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position is -amino cyclo-pentane carboxylic acid which structurally mimics Alanine.
  MISC_FEATURE (8)..(8): Modified residue at this position is N-methyl methionine which structurally mimics with methionine.
  MISC_FEATURE (11)..(11): Modified residue at this position is homoarginine(NO2) which structurally mimics with Arginine.
  MISC_FEATURE (13)..(13): Modified residue at this position N-methyl Lysine which structurally mimics with Lysine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 643 - protein, 15 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position is -amino cyclo-pentane carboxylic acid which structurally mimics Alanine.
  MISC_FEATURE (8)..(8): Modified residue at this position is N-methyl Norleucine which structurally mimics with methionine.
  MISC_FEATURE (11)..(11): Modified residue at this position is homoarginine(NO2) which structurally mimics with Arginine.
  MISC_FEATURE (13)..(13): Modified residue at this position N-methyl Lysine which structurally mimics with Lysine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 644 - protein, 15 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position is amino cyclo-pentane carboxylic acid which structurally mimics Alanine.
  MISC_FEATURE (8)..(8): Modified residue at this position is N-methyl methionine which structurally mimics with methionine.
  MISC_FEATURE (11)..(11): Modified residue at this position is homoarginine(NO2) which structurally mimics with Arginine.
  MISC_FEATURE (13)..(13): Modified residue at this position N-methyl Lysine which structurally mimics with Lysine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 645 - protein, 15 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position is amino cyclo-pentane carboxylic acid which structurally mimics Alanine.
  MISC_FEATURE (8)..(8): Modified residue at this position is N-methyl Norleucine which structurally mimics with methionine.
  MISC_FEATURE (11)..(11): Modified residue at this position is homoarginine(NO2) which structurally mimics with Arginine.
  MISC_FEATURE (13)..(13): Modified residue at this position N-methyl Lysine which structurally mimics with Lysine.
  MISC_FEATURE (14)..(14): Modified residue at this position is 2'-Ethyl-4'-methoxy-biphenylalanine which structurally mimics with Phenylalanine.
  MISC_FEATURE (15)..(15): Modified residue at this position is 2-Amino-5-phenylpentanoic acid which structurally mimics with phenylalanine.
AVAEIQLMHQRAKFF

SEQ ID NO: 646 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (7)..(7): Modified residue at this position is -alpha methyl phenylalanine which structurally mimics Phenylalanine.
  MISC_FEATURE (8)..(8): Modified residue at this position is -Norleucine which structurally mimics Methionine.
  MISC_FEATURE (11)..(11): Modified residue at this position is -Homo Citrulline which structurally mimics Arginine.
  MISC_FEATURE (12)..(12): Modified residue at this position mimics -alpha amino-isobutyric acid (Aib) which structurally mimics Alanine.
  MISC_FEATURE (13)..(13): Modified residue at this position is Citrulline which structurally mimics Arginine.
  MISC_FEATURE (14)..(14): Modified residue at this position is -alpha methyl phenylalanine which structurally mimics Phenylalanine.
AVAEIQLMHQRAKF

SEQ ID NO: 647 - protein, 14 aa, Artificial
  This short chain peptide was synthetically generated and prepared
  MISC_FEATURE (1)..(1): Modified residue at this position mimics -alpha amino-isobutyric acid (Aib) which structurally mimics Alanine.
  MISC_FEATURE (3)..(3): Modified residue at this position mimics -alpha amino-isobutyric acid (Aib) which structurally mimics Alanine.
  MISC_FEATURE (8)..(8): Modified residue at this position is -Norleucine which structurally mimics Methionine.
  MISC_FEATURE (11)..(11): Modified residue at this position is -Homo arginine which structurally mimics Arginine.
  MISC_FEATURE (14)..(14): Modified residue at this position is 2'-Ethyl-4'-methoxy-biphenylalanine which structurally mimics with Phenylalanine.
AVAEIQLMHQRAKF

SEQ ID NO: 648 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (11)..(11): Modified residue at this position is -Homo arginine which structurally mimics Arginine.
  MISC_FEATURE (14)..(14): Modified residue at this position is 2'-Ethyl-4'-methoxy-biphenylalanine which structurally mimics with Phenylalanine.
AVAEIQLMHQRAKF

SEQ ID NO: 649 - protein, 14 aa, Artificial
  This short chain peptide was synthetically generated and prepared
  MISC_FEATURE (1)..(1): Modified residue at this position is -amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (8)..(8): Modified residue at this position is -Norleucine which structurally mimics Methionine.
  MISC_FEATURE (11)..(11): Modified residue at this position is -Homo arginine which structurally mimics Arginine.
  MISC_FEATURE (14)..(14): Modified residue at this position is 2'-Ethyl-4'-methoxy-biphenylalanine which structurally mimics with Phenylalanine.
AVAEIQLMHQRAKF

SEQ ID NO: 650 - protein, 14 aa, Artificial
  This short chain peptide was synthetically generated and prepared
  MISC_FEATURE (1)..(1): Modified residue at this position is amino cyclo-pentane carboxylic acid which structurally mimics Alanine.
  MISC_FEATURE (3)..(3): Modified residue at this position mimics -alpha amino-isobutyric acid (Aib) which structurally mimics Alanine.
  MISC_FEATURE (11)..(11): Modified residue at this position is -Homo arginine which structurally mimics Arginine.
  MISC_FEATURE (14)..(14): Modified residue at this position is -alpha methyl phenylalanine which structurally mimics Phenylalanine.
AVAEIQLMHQRAKF

SEQ ID NO: 651 - protein, 14 aa, Artificial
  This sequence was synthetically synthesisized and prepared
  MISC_FEATURE (1)..(1): Modified residue at this position is amino cyclo-propane carboxylic acid which structurally mimics Alanine.
  MISC_FEATURE (3)..(3): Modified residue at this position is -alpha amino-isobutyric acid (Aib) which 	structurally mimics Alanine.
  MISC_FEATURE (8)..(8): Modified residue at this position is -Norleucine which structurally mimics Methionine.
  MISC_FEATURE (11)..(11): Modified residue at this position is Homoarginine which structurally mimics with Arginine
  MISC_FEATURE (14)..(14): Modified residue at this position is 2'-Ethyl-4'-methoxy-biphenylalanine which structurally mimics with Phenylalanine.
AVAEIQLLHQRAKF

SEQ ID NO: 652 - protein, 14 aa, Artificial
  This sequence was synthetically synthesisized and prepared
  MISC_FEATURE (1)..(1): Modified residue at this position is -alpha amino-isobutyric acid (Aib) which 	structurally mimics Alanine.
  MISC_FEATURE (3)..(3): Modified residue at this position is amino cyclo-propane carboxylic acid which structurally mimics Alanine.
  MISC_FEATURE (11)..(11): Modified residue at this position is Homoarginine which structurally mimics with Arginine
  MISC_FEATURE (14)..(14): Modified residue at this position is 2'-Ethyl-4'-methoxy-biphenylalanine which structurally mimics with Phenylalanine.
AVAEIQLMHQRAKF

SEQ ID NO: 653 - protein, 14 aa, Artificial
  This sequence was synthetically synthesisized and prepared
  MISC_FEATURE (1)..(1): Modified residue at this position is -alpha amino-isobutyric acid (Aib) which 	structurally mimics Alanine.
  MISC_FEATURE (3)..(3): Modified residue at this position is amino cyclo-propane carboxylic acid which structurally mimics Alanine.
  MISC_FEATURE (8)..(8): Modified residue at this position is -Norleucine which structurally mimics Methionine.
  MISC_FEATURE (11)..(11): Modified residue at this position is Homoarginine which structurally mimics with Arginine
  MISC_FEATURE (14)..(14): Modified residue at this position is 2'-Ethyl-4'-methoxy-biphenylalanine which structurally mimics with Phenylalanine.
AVAEIQLLHQRAKF

SEQ ID NO: 654 - protein, 14 aa, Artificial
  This sequence was synthetically synthesisized and prepared
  MISC_FEATURE (1)..(1): Modified residue at this position is amino cyclo-propane carboxylic acid which structurally mimics Alanine.
  MISC_FEATURE (3)..(3): Modified residue at this position is amino cyclo-propane carboxylic acid which structurally mimics Alanine.
  MISC_FEATURE (11)..(11): Modified residue at this position is Homoarginine which structurally mimics with Arginine
  MISC_FEATURE (14)..(14): Modified residue at this position is 2'-Ethyl-4'-methoxy-biphenylalanine which structurally mimics with Phenylalanine.
AVAEIQLMHQRAKF

SEQ ID NO: 655 - protein, 14 aa, Artificial
  This sequence was synthetically synthesisized and prepared
  MISC_FEATURE (1)..(1): Modified residue at this position is amino cyclo-propane carboxylic acid which structurally mimics Alanine.
  MISC_FEATURE (3)..(3): Modified residue at this position is amino cyclo-propane carboxylic acid which structurally mimics Alanine.
  MISC_FEATURE (8)..(8): Modified residue at this position is -Norleucine which structurally mimics Methionine.
  MISC_FEATURE (11)..(11): Modified residue at this position is Homoarginine which structurally mimics with Arginine
  MISC_FEATURE (14)..(14): Modified residue at this position is 2'-Ethyl-4'-methoxy-biphenylalanine which structurally mimics with Phenylalanine.
AVAEIQLLHQRAKF

SEQ ID NO: 656 - protein, 14 aa, Artificial
  This sequence was synthetically synthesisized and prepared
  MISC_FEATURE (1)..(1): Modified residue at this position is amino cyclo-pentane carboxylic acid which structurally mimics Alanine.
  MISC_FEATURE (3)..(3): Modified residue at this position is amino cyclo-propane carboxylic acid which structurally mimics Alanine.
  MISC_FEATURE (11)..(11): Modified residue at this position is Homoarginine which structurally mimics with Arginine
  MISC_FEATURE (14)..(14): Modified residue at this position is 2'-Ethyl-4'-methoxy-biphenylalanine which structurally mimics with Phenylalanine.
AVAEIQLMHQRAKF

SEQ ID NO: 657 - protein, 14 aa, Artificial
  This sequence was synthetically synthesisized and prepared
  MISC_FEATURE (1)..(1): Modified residue at this position is amino cyclo-pentane carboxylic acid which structurally mimics Alanine.
  MISC_FEATURE (3)..(3): Modified residue at this position is amino cyclo-propane carboxylic acid which structurally mimics Alanine.
  MISC_FEATURE (8)..(8): Modified residue at this position is -Norleucine which structurally mimics Methionine.
  MISC_FEATURE (11)..(11): Modified residue at this position is Homoarginine which structurally mimics with Arginine
  MISC_FEATURE (14)..(14): Modified residue at this position is 2'-Ethyl-4'-methoxy-biphenylalanine which structurally mimics with Phenylalanine.
AVAEIQLLHQRAKF

SEQ ID NO: 658 - protein, 14 aa, Artificial
  This sequence was synthetically synthesisized and prepared
  MISC_FEATURE (1)..(1): Modified residue at this position is -alpha amino-isobutyric acid (Aib) which 	structurally mimics Alanine.
  MISC_FEATURE (3)..(3): Modified residue at this position is -alpha amino-isobutyric acid (Aib) which 	structurally mimics Alanine.
  MISC_FEATURE (11)..(11): Modified residue at this position is Homoarginine (NO2) which structurally mimics with Arginine
  MISC_FEATURE (14)..(14): Modified residue at this position is 2'-Ethyl-4'-methoxy-biphenylalanine which structurally mimics with Phenylalanine.
AVAEIQLMHQRAKF

SEQ ID NO: 659 - protein, 14 aa, Artificial
  This sequence was synthetically synthesisized and prepared
  MISC_FEATURE (1)..(1): Modified residue at this position is -alpha amino-isobutyric acid (Aib) which 	structurally mimics Alanine.
  MISC_FEATURE (3)..(3): Modified residue at this position is -alpha amino-isobutyric acid (Aib) which 	structurally mimics Alanine.
  MISC_FEATURE (8)..(8): Modified residue at this position is -Norleucine which structurally mimics Methionine.
  MISC_FEATURE (11)..(11): Modified residue at this position is Homoarginine (NO2) which structurally mimics with Arginine
  MISC_FEATURE (14)..(14): Modified residue at this position is 2'-Ethyl-4'-methoxy-biphenylalanine which structurally mimics with Phenylalanine.
AVAEIQLLHQRAKF

SEQ ID NO: 660 - protein, 14 aa, Artificial
  This sequence was synthetically synthesisized and prepared
  MISC_FEATURE (1)..(1): Modified residue at this position is -alpha amino-isobutyric acid (Aib) which 	structurally mimics Alanine.
  MISC_FEATURE (3)..(3): Modified residue at this position is -alpha amino-isobutyric acid (Aib) which 	structurally mimics Alanine.
  MISC_FEATURE (11)..(11): Modified residue at this position is Homoarginine (NO2) which structurally mimics with Arginine
  MISC_FEATURE (13)..(13): Modified residue at this position is Lysine Biotin which structurally mimics with Lysine
  MISC_FEATURE (14)..(14): Modified residue at this position is 2'-Ethyl-4'-methoxy-biphenylalanine which structurally mimics with Phenylalanine.
AVAEIQLMHQRAKF

SEQ ID NO: 661 - protein, 14 aa, Artificial
  This sequence was synthetically synthesisized and prepared
  MISC_FEATURE (1)..(1): Modified residue at this position is -alpha amino-isobutyric acid (Aib) which 	structurally mimics Alanine.
  MISC_FEATURE (3)..(3): Modified residue at this position is -alpha amino-isobutyric acid (Aib) which 	structurally mimics Alanine.
  MISC_FEATURE (8)..(8): Modified residue at this position is -Norleucine which structurally mimics Methionine.
  MISC_FEATURE (11)..(11): Modified residue at this position is Homoarginine (NO2) which structurally mimics with Arginine
  MISC_FEATURE (13)..(13): Modified residue at this position is Lysine Biotin which structurally mimics with Lysine
  MISC_FEATURE (14)..(14): Modified residue at this position is 2'-Ethyl-4'-methoxy-biphenylalanine which structurally mimics with Phenylalanine.
AVAEIQLLHQRAKF

SEQ ID NO: 662 - protein, 14 aa, Artificial
  This sequence was synthetically synthesisized and prepared
  MISC_FEATURE (1)..(1): Modified residue at this position is -alpha amino-isobutyric acid (Aib) which 	structurally mimics Alanine.
  MISC_FEATURE (3)..(3): Modified residue at this position is -alpha amino-isobutyric acid (Aib) which 	structurally mimics Alanine.
  MISC_FEATURE (11)..(11): Modified residue at this position is Homoarginine which structurally mimics with Arginine
  MISC_FEATURE (13)..(13): Modified residue at this position is Lysine Biotin which structurally mimics with Lysine
  MISC_FEATURE (14)..(14): Modified residue at this position is 2'-Ethyl-4'-methoxy-biphenylalanine which structurally mimics with Phenylalanine.
AVAEIQLMHQRAKF

SEQ ID NO: 663 - protein, 14 aa, Artificial
  This sequence was synthetically synthesisized and prepared
  MISC_FEATURE (1)..(1): Modified residue at this position is -alpha amino-isobutyric acid (Aib) which 	structurally mimics Alanine.
  MISC_FEATURE (3)..(3): Modified residue at this position is -alpha amino-isobutyric acid (Aib) which 	structurally mimics Alanine.
  MISC_FEATURE (8)..(8): Modified residue at this position is -Norleucine which structurally mimics Methionine.
  MISC_FEATURE (11)..(11): Modified residue at this position is Homoarginine which structurally mimics with Arginine
  MISC_FEATURE (13)..(13): Modified residue at this position is Lysine Biotin which structurally mimics with Lysine
  MISC_FEATURE (14)..(14): Modified residue at this position is 2'-Ethyl-4'-methoxy-biphenylalanine which structurally mimics with Phenylalanine.
AVAEIQLLHQRAKF

SEQ ID NO: 664 - protein, 14 aa, Artificial
  This sequence was synthetically synthesisized and prepared
  MISC_FEATURE (1)..(1): Modified residue at this position is -alpha amino-isobutyric acid (Aib) which 	structurally mimics Alanine.
  MISC_FEATURE (3)..(3): Modified residue at this position is -alpha amino-isobutyric acid (Aib) which 	structurally mimics Alanine.
  MISC_FEATURE (11)..(11): Modified residue at this position is Homoarginine(NO2) which structurally mimics with Arginine
  MISC_FEATURE (13)..(13): Modified residue at this position is alkylated lysine K(CO(CH2)6-CH3) which structurally mimics with Lysine.
  MISC_FEATURE (14)..(14): Modified residue at this position is 2'-Ethyl-4'-methoxy-biphenylalanine which structurally mimics with Phenylalanine.
AVAEIQLMHQRAKF

SEQ ID NO: 665 - protein, 14 aa, Artificial
  This sequence was synthetically synthesisized and prepared
  MISC_FEATURE (1)..(1): Modified residue at this position is -alpha amino-isobutyric acid (Aib) which 	structurally mimics Alanine.
  MISC_FEATURE (3)..(3): Modified residue at this position is -alpha amino-isobutyric acid (Aib) which 	structurally mimics Alanine.
  MISC_FEATURE (8)..(8): Modified residue at this position is -Norleucine which structurally mimics Methionine.
  MISC_FEATURE (11)..(11): Modified residue at this position is Homoarginine(NO2) which structurally mimics with Arginine
  MISC_FEATURE (13)..(13): Modified residue at this position is alkylated lysine K(CO(CH2)6-CH3) which structurally mimics with Lysine.
  MISC_FEATURE (14)..(14): Modified residue at this position is 2'-Ethyl-4'-methoxy-biphenylalanine which structurally mimics with Phenylalanine.
AVAEIQLLHQRAKF

SEQ ID NO: 666 - protein, 14 aa, Artificial
  This sequence was synthetically synthesisized and prepared
  MISC_FEATURE (1)..(1): Modified residue at this position is -alpha amino-isobutyric acid (Aib) which 	structurally mimics Alanine.
  MISC_FEATURE (3)..(3): Modified residue at this position is -alpha amino-isobutyric acid (Aib) which 	structurally mimics Alanine.
  MISC_FEATURE (11)..(11): Modified residue at this position is Homoarginine(NO2) which structurally mimics with Arginine
  MISC_FEATURE (13)..(13): Modified residue at this position is alkylated lysine K(CO(CH2)6-CH3) which structurally mimics with Lysine.
  MISC_FEATURE (14)..(14): Modified residue at this position is 2'-Ethyl-4'-methoxy-biphenylalanine which structurally mimics with Phenylalanine.
AVAEIQLMHQRAKF

SEQ ID NO: 667 - protein, 14 aa, Artificial
  This sequence was synthetically synthesisized and prepared
  MISC_FEATURE (1)..(1): Modified residue at this position is -alpha amino-isobutyric acid (Aib) which 	structurally mimics Alanine.
  MISC_FEATURE (3)..(3): Modified residue at this position is -alpha amino-isobutyric acid (Aib) which 	structurally mimics Alanine.
  MISC_FEATURE (8)..(8): Modified residue at this position is -Norleucine which structurally mimics Methionine.
  MISC_FEATURE (11)..(11): Modified residue at this position is Homoarginine which structurally mimics with Arginine
  MISC_FEATURE (13)..(13): Modified residue at this position is alkylated lysine K(CO(CH2)6-CH3) which structurally mimics with Lysine.
  MISC_FEATURE (14)..(14): Modified residue at this position is 2'-Ethyl-4'-methoxy-biphenylalanine which structurally mimics with Phenylalanine.
AVAEIQLLHQRAKF

SEQ ID NO: 668 - protein, 14 aa, Artificial
  This sequence was synthetically synthesisized and prepared
  MISC_FEATURE (1)..(1): Modified residue at this position is -alpha amino-isobutyric acid (Aib) which 	structurally mimics Alanine.
  MISC_FEATURE (3)..(3): Modified residue at this position is -alpha amino-isobutyric acid (Aib) which 	structurally mimics Alanine.
  MISC_FEATURE (11)..(11): Modified residue at this position is Homoarginine(NO2) which structurally mimics with Arginine
  MISC_FEATURE (13)..(13): Modified residue at this position is alkylated lysine K(CO(CH2)6-CH3) which structurally mimics with Lysine.
  MISC_FEATURE (14)..(14): Modified residue at this position is 2'-Ethyl-4'-methoxy-biphenylalanine which structurally mimics with Phenylalanine.
AVAEIQLMHQRAKF

SEQ ID NO: 669 - protein, 14 aa, Artificial
  This sequence was synthetically synthesisized and prepared
  MISC_FEATURE (1)..(1): Modified residue at this position is -alpha amino-isobutyric acid (Aib) which 	structurally mimics Alanine.
  MISC_FEATURE (3)..(3): Modified residue at this position is -alpha amino-isobutyric acid (Aib) which 	structurally mimics Alanine.
  MISC_FEATURE (8)..(8): Modified residue at this position is -Norleucine which structurally mimics Methionine.
  MISC_FEATURE (11)..(11): Modified residue at this position is Homoarginine(NO2) which structurally mimics with Arginine
  MISC_FEATURE (13)..(13): Modified residue at this position is alkylated lysine K(CO(CH2)6-CH3) which structurally mimics with Lysine.
  MISC_FEATURE (14)..(14): Modified residue at this position is 2'-Ethyl-4'-methoxy-biphenylalanine which structurally mimics with Phenylalanine.
AVAEIQLLHQRAKF

SEQ ID NO: 670 - protein, 14 aa, Artificial
  This sequence was synthetically synthesisized and prepared
  MISC_FEATURE (1)..(1): Modified residue at this position is -alpha amino-isobutyric acid (Aib) which 	structurally mimics Alanine.
  MISC_FEATURE (3)..(3): Modified residue at this position is -alpha amino-isobutyric acid (Aib) which 	structurally mimics Alanine.
  MISC_FEATURE (11)..(11): Modified residue at this position is Homoarginine which structurally mimics with Arginine
  MISC_FEATURE (13)..(13): Modified residue at this position is alkylated lysine K(CO(CH2)6-CH3) which structurally mimics with Lysine.
  MISC_FEATURE (14)..(14): Modified residue at this position is 2'-Ethyl-4'-methoxy-biphenylalanine which structurally mimics with Phenylalanine.
AVAEIQLMHQRAKF

SEQ ID NO: 671 - protein, 14 aa, Artificial
  This sequence was synthetically synthesisized and prepared
  MISC_FEATURE (1)..(1): Modified residue at this position is -alpha amino-isobutyric acid (Aib) which 	structurally mimics Alanine.
  MISC_FEATURE (3)..(3): Modified residue at this position is -alpha amino-isobutyric acid (Aib) which 	structurally mimics Alanine.
  MISC_FEATURE (8)..(8): Modified residue at this position is -Norleucine which structurally mimics Methionine.
  MISC_FEATURE (11)..(11): Modified residue at this position is Homoarginine which structurally mimics with Arginine
  MISC_FEATURE (13)..(13): Modified residue at this position is alkylated lysine K(CO(CH2)6-CH3) which structurally mimics with Lysine.
  MISC_FEATURE (14)..(14): Modified residue at this position is 2'-Ethyl-4'-methoxy-biphenylalanine which structurally mimics with Phenylalanine.
AVAEIQLLHQRAKF

SEQ ID NO: 672 - protein, 14 aa, Artificial
  This sequence was synthetically synthesisized and prepared
  MISC_FEATURE (1)..(1): Modified residue at this position is amino cyclo-pentane carboxylic acid which structurally mimics Alanine.
  MISC_FEATURE (3)..(3): Modified residue at this position is amino cyclo-propane carboxylic acid which structurally mimics Alanine.
  MISC_FEATURE (11)..(11): Modified residue at this position is Homoarginine which structurally mimics with Arginine
  MISC_FEATURE (13)..(13): Modified residue at this position is alkylated lysine K(CO(CH2)6-CH3) which structurally mimics with Lysine.
  MISC_FEATURE (14)..(14): Modified residue at this position is 2'-Ethyl-4'-methoxy-biphenylalanine which structurally mimics with Phenylalanine.
AVAEIQLMHQRAKF

SEQ ID NO: 673 - protein, 14 aa, Artificial
  This sequence was synthetically synthesisized and prepared
  MISC_FEATURE (1)..(1): Modified residue at this position is amino cyclo-pentane carboxylic acid which structurally mimics Alanine.
  MISC_FEATURE (3)..(3): Modified residue at this position is amino cyclo-propane carboxylic acid which structurally mimics Alanine.
  MISC_FEATURE (8)..(8): Modified residue at this position is -Norleucine which structurally mimics Methionine.
  MISC_FEATURE (11)..(11): Modified residue at this position is Homoarginine which structurally mimics with Arginine
  MISC_FEATURE (13)..(13): Modified residue at this position is alkylated lysine K(CO(CH2)6-CH3) which structurally mimics with Lysine.
  MISC_FEATURE (14)..(14): Modified residue at this position is 2'-Ethyl-4'-methoxy-biphenylalanine which structurally mimics with Phenylalanine.
AVAEIQLLHQRAKF

SEQ ID NO: 674 - protein, 14 aa, Artificial
  This sequence was synthetically synthesisized and prepared
  MISC_FEATURE (1)..(1): Modified residue at this position is amino cyclo-pentane carboxylic acid which structurally mimics Alanine.
  MISC_FEATURE (3)..(3): Modified residue at this position is amino cyclo-propane carboxylic acid which structurally mimics Alanine.
  MISC_FEATURE (11)..(11): Modified residue at this position is Homoarginine(NO2) which structurally mimics with Arginine
  MISC_FEATURE (13)..(13): Modified residue at this position N-methyl Lysine which structurally mimics with Lysine.
  MISC_FEATURE (14)..(14): Modified residue at this position is 2'-Ethyl-4'-methoxy-biphenylalanine which structurally mimics with Phenylalanine.
AVAEIQLMHQRAKF

SEQ ID NO: 675 - protein, 14 aa, Artificial
  This sequence was synthetically synthesisized and prepared
  MISC_FEATURE (1)..(1): Modified residue at this position is amino cyclo-pentane carboxylic acid which structurally mimics Alanine.
  MISC_FEATURE (3)..(3): Modified residue at this position is amino cyclo-propane carboxylic acid which structurally mimics Alanine.
  MISC_FEATURE (8)..(8): Modified residue at this position is -Norleucine which structurally mimics Methionine.
  MISC_FEATURE (11)..(11): Modified residue at this position is Homoarginine(NO2) which structurally mimics with Arginine
  MISC_FEATURE (13)..(13): Modified residue at this position N-methyl Lysine which structurally mimics with Lysine.
  MISC_FEATURE (14)..(14): Modified residue at this position is 2'-Ethyl-4'-methoxy-biphenylalanine which structurally mimics with Phenylalanine.
AVAEIQLLHQRAKF

SEQ ID NO: 676 - protein, 14 aa, Artificial
  This short-chain peptide was synthetically generated and prepared
  MISC_FEATURE (1)..(1): Modified residue at this position is alpha-amino isobutyric acid (Aib), which structurally mimics alanine.
  MISC_FEATURE (3)..(3): Modified residue at this position is alpha-amino isobutyric acid (Aib), which structurally mimics alanine.
  MISC_FEATURE (8)..(8): Modified residue at this position is N-methyl methionine ((NMe)M) which  structurally mimics Methionine
  MISC_FEATURE (13)..(13): Modified residue at this position is alkylated lysine (K(-CO-(CH2)8-CH3)) which structurally mimics Lysine.
  MISC_FEATURE (14)..(14): Modified residue at this position is 2'-Ethyl-4'-methoxy-biphenylalanine (Bip(OMe)) which structurally mimics Phenyl alanine.
AVAEIQLMHQRAKF

SEQ ID NO: 677 - protein, 14 aa, Artificial
  This short-chain peptide was synthetically generated and prepared
  MISC_FEATURE (1)..(1): Modified residue at this position is alpha-amino-isobutyric acid (Aib) which structurally mimics Alanine.
  MISC_FEATURE (3)..(3): Modified residue at this position is alpha-amino-isobutyric acid (Aib) which structurally mimics Alanine.
  MISC_FEATURE (8)..(8): Modified residue at this position is N-methyl Norleucine ((NMe)Nle) which structurally mimics Methionine
  MISC_FEATURE (13)..(13): Modified residue at this position is alkylated lysine (K(-CO-(CH2)8-CH3)) which structurally mimics Lysine
  MISC_FEATURE (14)..(14): Modified residue at this position is 2'-Ethyl-4'-methoxy-biphenylalanine (Bip(OMe)) which structurally mimics Phenyl alanine
AVAEIQLMHQRAKF

SEQ ID NO: 678 - protein, 14 aa, Artificial
  This short-chain peptide was synthetically generated and prepared
  MISC_FEATURE (1)..(1): Modified residue at this position is 1-amino cyclopropane carboxylic acid (AC3C) which structurally mimics alanine
  MISC_FEATURE (3)..(3): Modified residue at this position is alpha-amino-isobutyric acid (Aib) which structurally mimics Alanine
  MISC_FEATURE (8)..(8): Modified residue at this position is N-methyl methionine ((NMe)M) which structurally mimics Methionine
  MISC_FEATURE (11)..(11): Modified residue at this position is Homoarginine (Har) which structurally mimics Arginine
  MISC_FEATURE (13)..(13): Modified residue at this position is Alkylated lysine (K(-CO-(CH2)8-CH3)) which structurally mimics Lysine
  MISC_FEATURE (14)..(14): Modified residue at this position is 2'-Ethyl-4'-methoxy-biphenylalanine (Bip(OMe)) which structurally mimics Phenyl alanine
AVAEIQLMHQRAKF

SEQ ID NO: 679 - protein, 14 aa, Artificial
  This short-chain peptide was synthetically generated and prepared
  MISC_FEATURE (1)..(1): Modified residue at this position is 1-amino cyclopropane carboxylic acid (AC3C) which structurally mimics alanine
  MISC_FEATURE (3)..(3): Modified residue at this position is alpha-amino-isobutyric acid (Aib) which structurally mimics Alanine
  MISC_FEATURE (8)..(8): Modified residue at this position is N-methyl Norleucine ((NMe)Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Alkylated lysine (K(-CO-(CH2)8-CH3)) which structurally mimics Lysine
  MISC_FEATURE (14)..(14): Modified residue at this position is 2'-Ethyl-4'-methoxy-biphenylalanine (Bip(OMe)) which structurally mimics Phenyl alanine
AVAEIQLMHQRAKF

SEQ ID NO: 680 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 681 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 682 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(13): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 683 - protein, 15 aa, Artificial
  This short-chain peptide was synthetically generated and prepared
  MISC_FEATURE (1)..(1): Modified residue at this position is 1-amino cyclopropane carboxylic acid (AC3C) which structurally mimics alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 684 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 685 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (11)..(11): Modified residue at this position is Homoarginine (Har) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is Arginine(Nitro) (Arg(NO2)) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 686 - protein, 15 aa, Artificial
  This short-chain peptide was synthetically generated and prepared
  MISC_FEATURE (1)..(1): Modified residue at this position is alpha-amino isobutyric acid (Aib), which structurally mimics alanine.
  MISC_FEATURE (3)..(3): Modified residue at this position is alpha-amino isobutyric acid (Aib), which structurally mimics alanine.
  MISC_FEATURE (8)..(8): Modified residue at this position is N-methyl methionine ((NMe)M) which  structurally mimics Methionine
  MISC_FEATURE (13)..(13): Modified residue at this position is alkylated lysine (K(-CO-(CH2)8-CH3)) which structurally mimics Lysine.
  MISC_FEATURE (14)..(14): Modified residue at this position is 2'-Ethyl-4'-methoxy-biphenylalanine (Bip(OMe)) which structurally mimics Phenyl alanine.
AVAEIQLMHQRARFF

SEQ ID NO: 687 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine.
  MISC_FEATURE (3)..(3): Modified residue at this position is alpha-amino-isobutyric acid (Aib) which structurally mimics Alanine.
  MISC_FEATURE (8)..(8): Modified residue at this position is N-methyl Norleucine ((NMe)Nle) which structurally mimics Methionine
  MISC_FEATURE (13)..(13): Modified residue at this position is alkylated lysine (K(-CO-(CH2)8-CH3)) which structurally mimics Lysine
  MISC_FEATURE (14)..(14): Modified residue at this position is 2'-Ethyl-4'-methoxy-biphenylalanine (Bip(OMe)) which structurally mimics Phenyl alanine
AVAEIQLMHQRARFF

SEQ ID NO: 688 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is 1-amino cyclopropane carboxylic acid (AC3C) which structurally mimics Alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 689 - protein, 15 aa, Artificial
  This short-chain peptide was synthetically generated and prepared
  MISC_FEATURE (1)..(1): Modified residue at this position is 1-amino cyclopropane carboxylic acid (AC3C) which structurally mimics alanine
  MISC_FEATURE (3)..(3): Modified residue at this position is 1-amino cyclopropane carboxylic acid (AC3C) which structurally mimics alanine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 690 - protein, 15 aa, Artificial
  This short-chain peptide was synthetically generated and prepared
  MISC_FEATURE (1)..(1): Modified residue at this position is 1-amino cyclopropane carboxylic acid (AC3C) which structurally mimics Alanine
  MISC_FEATURE (3)..(3): Modified residue at this position is 1-amino cyclopropane carboxylic acid (AC3C) which structurally mimics Alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 691 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is 1-amino cyclopropane carboxylic acid (AC3C) which structurally mimics Alanine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 692 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is 1-amino cyclopropane carboxylic acid (AC3C) which structurally mimics Alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(13): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 693 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine ( -Me-2,6F-Phe) which structurally mimics Phenyl alanine.
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 694 - protein, 15 aa, Artificial
  This short-chain peptide was synthetically generated and prepared
  MISC_FEATURE (1)..(1): Modified residue at this position is 1-amino cyclopropane carboxylic acid (AC3C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine.
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 695 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine ( -Me-2,6F-Phe) which structurally mimics Phenyl alanine.
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 696 - protein, 15 aa, Artificial
  This short-chain peptide was synthetically generated and prepared
  MISC_FEATURE (1)..(1): Modified residue at this position is alpha-amino isobutyric acid (Aib), which structurally mimics alanine.
  MISC_FEATURE (3)..(3): Modified residue at this position is 1-amino cyclopropane carboxylic acid (AC3C) which structurally mimics Alanine
  MISC_FEATURE (7)..(7): Modified residue at this position is alpha-methyl-2,6-diflurophenylalanine ( -Me-2,6F-Phe) which structurally mimics Phenyl alanine.
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is 2'-Ethyl-4'-methoxy-biphenylalanine (Bip(OMe)) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 697 - protein, 15 aa, Artificial
  This short-chain peptide was synthetically generated and prepared
  MISC_FEATURE (1)..(1): Modified residue at this position is 1-amino cyclopropane carboxylic acid (AC3C) which structurally mimics Alanine
  MISC_FEATURE (3)..(3): Modified residue at this position is 1-amino cyclopropane carboxylic acid (AC3C) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine.
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 698 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is 1-amino cyclopropane carboxylic acid (AC3C) which structurally mimics Alanine
  MISC_FEATURE (7)..(7): Modified residue at this position is alpha-methyl-2,6-diflurophenylalanine ( -Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is 2'-Ethyl-4'-methoxy-biphenylalanine (Bip(OMe)) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 699 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine.
  MISC_FEATURE (3)..(3): Modified residue at this position is alpha-amino-isobutyric acid (Aib) which structurally mimics Alanine.
  MISC_FEATURE (7)..(7): Modified residue at this position is alpha-methyl-2,6-diflurophenylalanine (alpha -Me-2,6F-Phe) which structurally mimics Phenyl alanine.
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 700 - protein, 15 aa, Artificial
  This short-chain peptide was synthetically generated and prepared
  MISC_FEATURE (1)..(1): Modified residue at this position is 1-amino cyclopropane carboxylic acid (AC3C) which structurally mimics Alanine
  MISC_FEATURE (3)..(3): Modified residue at this position is alpha-amino-isobutyric acid (Aib) which structurally mimics Alanine.
  MISC_FEATURE (7)..(7): Modified residue at this position is alpha-methyl-2,6-diflurophenylalanine (alpha -Me-2,6F-Phe) which structurally mimics Phenyl alanine.
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 701 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 702 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is 1-amino cyclopropane carboxylic acid (AC3C) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 703 - protein, 15 aa, Artificial
  This short-chain peptide was synthetically generated and prepared
  MISC_FEATURE (1)..(1): Modified residue at this position is 1-amino cyclopropane carboxylic acid (AC3C) which structurally mimics Alanine
  MISC_FEATURE (3)..(3): Modified residue at this position is 1-amino cyclopropane carboxylic acid (AC3C) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 704 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is 1-amino cyclopropane carboxylic acid (AC3C) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 705 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 706 - protein, 15 aa, Artificial
  This short-chain peptide was synthetically generated and prepared
  MISC_FEATURE (1)..(1): Modified residue at this position is 1-amino cyclopropane carboxylic acid (AC3C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 707 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 708 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is 1-amino cyclopropane carboxylic acid (AC3C) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 709 - protein, 15 aa, Artificial
  This short-chain peptide was synthetically generated and prepared
  MISC_FEATURE (1)..(1): Modified residue at this position is 1-amino cyclopropane carboxylic acid (AC3C) which structurally mimics Alanine
  MISC_FEATURE (3)..(3): Modified residue at this position is 1-amino cyclopropane carboxylic acid (AC3C) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 710 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is 1-amino cyclopropane carboxylic acid (AC3C) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 711 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 712 - protein, 15 aa, Artificial
  This short-chain peptide was synthetically generated and prepared
  MISC_FEATURE (1)..(1): Modified residue at this position is 1-amino cyclopropane carboxylic acid (AC3C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 713 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 714 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is 1-amino cyclopropane carboxylic acid (AC3C) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 715 - protein, 15 aa, Artificial
  This short-chain peptide was synthetically generated and prepared
  MISC_FEATURE (1)..(1): Modified residue at this position is 1-amino cyclopropane carboxylic acid (AC3C) which structurally mimics Alanine
  MISC_FEATURE (3)..(3): Modified residue at this position is 1-amino cyclopropane carboxylic acid (AC3C) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 716 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is 1-amino cyclopropane carboxylic acid (AC3C) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 717 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 718 - protein, 15 aa, Artificial
  This short-chain peptide was synthetically generated and prepared
  MISC_FEATURE (1)..(1): Modified residue at this position is 1-amino cyclopropane carboxylic acid (AC3C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 719 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 720 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is 1-amino cyclopropane carboxylic acid (AC3C) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 721 - protein, 15 aa, Artificial
  This short-chain peptide was synthetically generated and prepared
  MISC_FEATURE (1)..(1): Modified residue at this position is 1-amino cyclopropane carboxylic acid (AC3C) which structurally mimics Alanine
  MISC_FEATURE (3)..(3): Modified residue at this position is 1-amino cyclopropane carboxylic acid (AC3C) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 722 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is 1-amino cyclopropane carboxylic acid (AC3C) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 723 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 724 - protein, 15 aa, Artificial
  This short-chain peptide was synthetically generated and prepared
  MISC_FEATURE (1)..(1): Modified residue at this position is 1-amino cyclopropane carboxylic acid (AC3C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 725 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 726 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 727 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is 1-amino cyclopropane carboxylic acid (AC3C) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 728 - protein, 15 aa, Artificial
  This short-chain peptide was synthetically generated and prepared
  MISC_FEATURE (1)..(1): Modified residue at this position is 1-amino cyclopropane carboxylic acid (AC3C) which structurally mimics Alanine
  MISC_FEATURE (3)..(3): Modified residue at this position is 1-amino cyclopropane carboxylic acid (AC3C) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 729 - protein, 15 aa, Artificial
  This short-chain peptide was synthetically generated and prepared
  MISC_FEATURE (1)..(1): Modified residue at this position is 1-amino cyclopropane carboxylic acid (AC3C) which structurally mimics Alanine
  MISC_FEATURE (3)..(3): Modified residue at this position is 1-amino cyclopropane carboxylic acid (AC3C) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Arginine(Nitro) (Arg(NO2)) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 730 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 731 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 732 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Citrulline (Cit) which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 733 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Citrulline (Cit) which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 734 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAAFF

SEQ ID NO: 735 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAAFF

SEQ ID NO: 736 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAFFF

SEQ ID NO: 737 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAFFF

SEQ ID NO: 738 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (12)..(12): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 739 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (12)..(12): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 740 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is Citrulline (Cit) which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 741 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is Citrulline (Cit) which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 742 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAAFF

SEQ ID NO: 743 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is Citrulline (Cit) which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAAFF

SEQ ID NO: 744 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAFFF

SEQ ID NO: 745 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAFFF

SEQ ID NO: 746 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 747 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 748 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine.
  MISC_FEATURE (13)..(13): Modified residue at this position is Citrulline (Cit) which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 749 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine.
  MISC_FEATURE (13)..(13): Modified residue at this position is Citrulline (Cit) which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 750 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine.
  MISC_FEATURE (13)..(13): Modified residue at this position is Citrulline (Cit) which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAAFF

SEQ ID NO: 751 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine.
  MISC_FEATURE (13)..(13): Modified residue at this position is Citrulline (Cit) which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAAFF

SEQ ID NO: 752 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine.
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAFFF

SEQ ID NO: 753 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine.
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAFFF

SEQ ID NO: 754 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine.
  MISC_FEATURE (12)..(12): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 755 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine.
  MISC_FEATURE (12)..(12): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 756 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine.
  MISC_FEATURE (12)..(12): Modified residue at this position is alpha-amino-isobutyric acid (Aib) which structurally mimics Alanine
  MISC_FEATURE (13)..(13): Modified residue at this position is Citrulline (Cit) which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 757 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine.
  MISC_FEATURE (12)..(12): Modified residue at this position is alpha-amino-isobutyric acid (Aib) which structurally mimics Alanine
  MISC_FEATURE (13)..(13): Modified residue at this position is Citrulline (Cit) which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 758 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine.
  MISC_FEATURE (12)..(12): Modified residue at this position is alpha-amino-isobutyric acid (Aib) which structurally mimics Alanine
  MISC_FEATURE (13)..(13): Modified residue at this position is Citrulline (Cit) which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAAFF

SEQ ID NO: 759 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine.
  MISC_FEATURE (12)..(12): Modified residue at this position is alpha-amino-isobutyric acid (Aib) which structurally mimics Alanine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAAFF

SEQ ID NO: 760 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine.
  MISC_FEATURE (12)..(12): Modified residue at this position is alpha-amino-isobutyric acid (Aib) which structurally mimics Alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAFFF

SEQ ID NO: 761 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine.
  MISC_FEATURE (12)..(12): Modified residue at this position is alpha-amino-isobutyric acid (Aib) which structurally mimics Alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAFFF

SEQ ID NO: 762 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 763 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 764 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine.
  MISC_FEATURE (13)..(13): Modified residue at this position is Citrulline (Cit) which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 765 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine.
  MISC_FEATURE (13)..(13): Modified residue at this position is Citrulline (Cit) which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 766 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine.
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAAFF

SEQ ID NO: 767 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine.
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAAFF

SEQ ID NO: 768 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine.
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAFFF

SEQ ID NO: 769 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine.
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAFFF

SEQ ID NO: 770 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine.
  MISC_FEATURE (12)..(12): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 771 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine.
  MISC_FEATURE (12)..(12): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 772 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine.
  MISC_FEATURE (12)..(12): Modified residue at this position is alpha-amino-isobutyric acid (Aib) which structurally mimics Alanine
  MISC_FEATURE (13)..(13): Modified residue at this position is Citrulline (Cit) which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 773 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine.
  MISC_FEATURE (12)..(12): Modified residue at this position is alpha-amino-isobutyric acid (Aib) which structurally mimics Alanine
  MISC_FEATURE (13)..(13): Modified residue at this position is Citrulline (Cit) which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 774 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine.
  MISC_FEATURE (12)..(12): Modified residue at this position is alpha-amino-isobutyric acid (Aib) which structurally mimics Alanine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAAFF

SEQ ID NO: 775 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine.
  MISC_FEATURE (12)..(12): Modified residue at this position is alpha-amino-isobutyric acid (Aib) which structurally mimics Alanine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAAFF

SEQ ID NO: 776 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine.
  MISC_FEATURE (12)..(12): Modified residue at this position is alpha-amino-isobutyric acid (Aib) which structurally mimics Alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAFFF

SEQ ID NO: 777 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine.
  MISC_FEATURE (12)..(12): Modified residue at this position is alpha-amino-isobutyric acid (Aib) which structurally mimics Alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAFFF

SEQ ID NO: 778 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 779 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 780 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (13)..(13): Modified residue at this position is Citrulline (Cit) which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 781 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (13)..(13): Modified residue at this position is Citrulline (Cit) which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 782 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAAFF

SEQ ID NO: 783 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAAFF

SEQ ID NO: 784 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAFFF

SEQ ID NO: 785 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAFFF

SEQ ID NO: 786 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (12)..(12): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 787 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (12)..(12): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 788 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is Citrulline (Cit) which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 789 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is Citrulline (Cit) which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 790 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAAFF

SEQ ID NO: 791 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAAFF

SEQ ID NO: 792 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAFFF

SEQ ID NO: 793 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAFFF

SEQ ID NO: 794 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQFARFF

SEQ ID NO: 795 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQFARFF

SEQ ID NO: 796 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQFARFF

SEQ ID NO: 797 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (13)..(13): Modified residue at this position is Citrulline (Cit) which structurally mimics Arginine.
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQFARFF

SEQ ID NO: 798 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQFAAFF

SEQ ID NO: 799 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQFAAFF

SEQ ID NO: 800 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQFAFFF

SEQ ID NO: 801 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQFAFFF

SEQ ID NO: 802 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (12)..(12): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQFARFF

SEQ ID NO: 803 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (12)..(12): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQFARFF

SEQ ID NO: 804 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (12)..(12): Modified residue at this position is alpha-amino-isobutyric acid (Aib) which structurally mimics Alanine
  MISC_FEATURE (13)..(13): Modified residue at this position is Citrulline (Cit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQFARFF

SEQ ID NO: 805 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (12)..(12): Modified residue at this position is alpha-amino-isobutyric acid (Aib) which structurally mimics Alanine
  MISC_FEATURE (13)..(13): Modified residue at this position is Citrulline (Cit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQFARFF

SEQ ID NO: 806 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (12)..(12): Modified residue at this position is alpha-amino-isobutyric acid (Aib) which structurally mimics Alanine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQFAAFF

SEQ ID NO: 807 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (12)..(12): Modified residue at this position is alpha-amino-isobutyric acid (Aib) which structurally mimics Alanine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQFAAFF

SEQ ID NO: 808 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (12)..(12): Modified residue at this position is alpha-amino-isobutyric acid (Aib) which structurally mimics Alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQFAFFF

SEQ ID NO: 809 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (12)..(12): Modified residue at this position is alpha-amino-isobutyric acid (Aib) which structurally mimics Alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQFAFFF

SEQ ID NO: 810 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 811 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 812 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Citrulline (Cit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 813 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Citrulline (Cit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 814 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAAFF

SEQ ID NO: 815 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAAFF

SEQ ID NO: 816 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAFFF

SEQ ID NO: 817 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAFFF

SEQ ID NO: 818 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 819 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 820 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is Citrulline (Cit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 821 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is Citrulline (Cit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 822 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAAFF

SEQ ID NO: 823 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAAFF

SEQ ID NO: 824 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAFFF

SEQ ID NO: 825 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAFFF

SEQ ID NO: 826 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 827 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine
  MISC_FEATURE (13)..(13): Modified residue at this position is Citrulline (Cit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 828 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine
  MISC_FEATURE (13)..(13): Modified residue at this position is Citrulline (Cit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 829 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine
  MISC_FEATURE (13)..(13): Modified residue at this position is Citrulline (Cit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 830 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAAFF

SEQ ID NO: 831 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAAFF

SEQ ID NO: 832 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAFFF

SEQ ID NO: 833 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAFFF

SEQ ID NO: 834 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine
  MISC_FEATURE (12)..(12): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 835 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine
  MISC_FEATURE (12)..(12): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 836 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is Citrulline (Cit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 837 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is Citrulline (Cit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 838 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAAFF

SEQ ID NO: 839 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAAFF

SEQ ID NO: 840 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAFFF

SEQ ID NO: 841 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Orn which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAFFF

SEQ ID NO: 842 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 843 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 844 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine
  MISC_FEATURE (13)..(13): Modified residue at this position is Citrulline (Cit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 845 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine
  MISC_FEATURE (13)..(13): Modified residue at this position is Citrulline (Cit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 846 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAAFF

SEQ ID NO: 847 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAAFF

SEQ ID NO: 848 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAFFF

SEQ ID NO: 849 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAFFF

SEQ ID NO: 850 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine
  MISC_FEATURE (12)..(12): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 851 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine
  MISC_FEATURE (12)..(12): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 852 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is Citrulline (Cit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 853 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 854 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAAFF

SEQ ID NO: 855 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAAFF

SEQ ID NO: 856 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAFFF

SEQ ID NO: 857 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is Citrulline (Cit) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAFFF

SEQ ID NO: 858 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 859 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 860 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (13)..(13): Modified residue at this position is Citrulline (Cit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 861 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (13)..(13): Modified residue at this position is Citrulline (Cit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 862 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAAFF

SEQ ID NO: 863 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAAFF

SEQ ID NO: 864 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAFFF

SEQ ID NO: 865 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAFFF

SEQ ID NO: 866 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (12)..(12): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 867 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (12)..(12): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 868 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (12)..(12): Modified residue at this position is alpha-amino-isobutyric acid (Aib) which structurally mimics Alanine
  MISC_FEATURE (12)..(12): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 869 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is Citrulline (Cit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRARFF

SEQ ID NO: 870 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAAFF

SEQ ID NO: 871 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAAFF

SEQ ID NO: 872 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAFFF

SEQ ID NO: 873 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is HomoCitrulline (HoCit) which structurally mimics Arginine
  MISC_FEATURE (12)..(12): Modified residue at this position is alpha-amino-isobutyric acid (Aib) which structurally mimics Alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQRAFFF

SEQ ID NO: 874 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQFARFF

SEQ ID NO: 875 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQFARFF

SEQ ID NO: 876 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (13)..(13): Modified residue at this position is Citrulline (Cit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQFARFF

SEQ ID NO: 877 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (13)..(13): Modified residue at this position is Citrulline (Cit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQFARFF

SEQ ID NO: 878 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQFAAFF

SEQ ID NO: 879 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQFAAFF

SEQ ID NO: 880 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQFAFFF

SEQ ID NO: 881 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQFAFFF

SEQ ID NO: 882 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQFARFF

SEQ ID NO: 883 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (12)..(12): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQFARFF

SEQ ID NO: 884 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (12)..(12): Modified residue at this position is alpha-amino-isobutyric acid (Aib) which structurally mimics Alanine
  MISC_FEATURE (13)..(13): Modified residue at this position is Citrulline (Cit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQFARFF

SEQ ID NO: 885 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (12)..(12): Modified residue at this position is alpha-amino-isobutyric acid (Aib) which structurally mimics Alanine
  MISC_FEATURE (13)..(13): Modified residue at this position is Citrulline (Cit) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQFARFF

SEQ ID NO: 886 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (12)..(12): Modified residue at this position is alpha-amino-isobutyric acid (Aib) which structurally mimics Alanine
  MISC_FEATURE (13)..(13): Modified residue at this position is alpha-amino-isobutyric acid (Aib) which structurally mimics Alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQFAAFF

SEQ ID NO: 887 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (12)..(12): Modified residue at this position is alpha-amino-isobutyric acid (Aib) which structurally mimics Alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQFAAFF

SEQ ID NO: 888 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (12)..(12): Modified residue at this position is alpha-amino-isobutyric acid (Aib) which structurally mimics Alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQFAFFF

SEQ ID NO: 889 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (7)..(7): Modified residue at this position is alpha-methyl-2,6-diflurophenylalanine (alpha-Me-2,6F-Phe) which structurally mimics Phenyl alanine
  MISC_FEATURE (8)..(8): Modified residue at this position is Norleucine (Nle) which structurally mimics Methionine
  MISC_FEATURE (11)..(11): Modified residue at this position is alpha-methyl-2,6-diflurophenylalanine (alpha-Me-2,6F-Phe) which structurally mimics Phenyl alanine
  MISC_FEATURE (12)..(12): Modified residue at this position is alpha-amino-isobutyric acid (Aib) which structurally mimics Alanine
  MISC_FEATURE (13)..(13): Modified residue at this position is alpha-methyl-2,6-diflurophenylalanine (alpha-Me-2,6F-Phe) which structurally mimics Phenyl alanine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQFMHQFAFFF

SEQ ID NO: 890 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (11)..(11): Modified residue at this position is Homoarginine (Har) which structurally mimics Arginine
  MISC_FEATURE (14)..(14): Modified residue at this position is alpha-Me-Bip(OMe) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAKAF

SEQ ID NO: 891 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is alpha-amino-isobutyric acid (Aib) which structurally mimics Alanine
  MISC_FEATURE (11)..(11): Modified residue at this position is Homoarginine (Har) which structurally mimics Arginine
  MISC_FEATURE (14)..(14): Modified residue at this position is alpha-Me-Bip(OMe) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRAKAF

SEQ ID NO: 892 - protein, 16 aa, Artificial
  This short-chain peptide was synthetically generated and prepared
  MISC_FEATURE (2)..(2): Modified residue at this position is alpha-amino-isobutyric acid (Aib) which structurally mimics Alanine
  MISC_FEATURE (4)..(4): Modified residue at this position is alpha-amino-isobutyric acid (Aib) which structurally mimics Alanine
  MISC_FEATURE (12)..(12): Modified residue at this position is Homoarginine (Har) which structurally mimics Arginine
  MISC_FEATURE (15)..(15): Modified residue at this position is alpha-Me-Bip(OMe) which structurally mimics Phenyl alanine
  MISC_FEATURE (16)..(16): Modified residue at this position is alpha-Me-APPA which structurally mimics Phenyl alanine
VAVAEIQLMHQRAKFF

SEQ ID NO: 893 - protein, 16 aa, Artificial
  This short-chain peptide was synthetically generated and prepared
  MISC_FEATURE (2)..(2): Modified residue at this position is alpha-amino-isobutyric acid (Aib) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is Norleucine (Nle) which structurally mimics Methionine
  MISC_FEATURE (12)..(12): Modified residue at this position is Homoarginine (Har) which structurally mimics Arginine
  MISC_FEATURE (15)..(15): Modified residue at this position is alpha-Me-Bip(OMe) which structurally mimics Phenyl alanine
  MISC_FEATURE (16)..(16): Modified residue at this position is alpha-Me-APPA which structurally mimics Phenyl alanine
VAVAEIQLMHQRAKFF

SEQ ID NO: 894 - protein, 16 aa, Artificial
  This short-chain peptide was synthetically generated and prepared
  MISC_FEATURE (1)..(1): Modified residue at this position is alpha-Me-V which structurally mimics Valine
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (12)..(12): Modified residue at this position is Homoarginine (Har) which structurally mimics Arginine
  MISC_FEATURE (15)..(15): Modified residue at this position is alpha-Me-Bip(OMe) which structurally mimics Phenyl alanine
  MISC_FEATURE (16)..(16): Modified residue at this position is 2-amino-5-phenylpentanoic acid (APPA) which structurally mimics Phenyl alanine
  MISC_FEATURE (16)..(16): Modified residue at this position is alpha-Me-APPA which structurally mimics Phenyl alanine
VAVAEIQLMHQRAKFF

SEQ ID NO: 895 - protein, 16 aa, Artificial
  This short-chain peptide was synthetically generated and prepared
  MISC_FEATURE (1)..(1): Modified residue at this position is alpha-Me-V which structurally mimics Valine
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is Norleucine (Nle) which structurally mimics Methionine
  MISC_FEATURE (12)..(12): Modified residue at this position is Homoarginine (Har) which structurally mimics Arginine
  MISC_FEATURE (15)..(15): Modified residue at this position is alpha-Me-Bip(OMe) which structurally mimics Phenyl alanine
  MISC_FEATURE (16)..(16): Modified residue at this position is alpha-Me-APPA which structurally mimics Phenyl alanine
VAVAEIQLMHQRAKFF

SEQ ID NO: 896 - protein, 16 aa, Artificial
  This short-chain peptide was synthetically generated and prepared
  MISC_FEATURE (1)..(1): Modified residue at this position is NMe-V which structurally mimics Valine
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is Norleucine (Nle) which structurally mimics Methionine
  MISC_FEATURE (12)..(12): Modified residue at this position is Homoarginine (Har) which structurally mimics Arginine
  MISC_FEATURE (15)..(15): Modified residue at this position is alpha-Me-Bip(OMe) which structurally mimics Phenyl alanine
  MISC_FEATURE (16)..(16): Modified residue at this position is alpha-Me-APPA which structurally mimics Phenyl alanine
VAVAEIQLMHQRAKFF

SEQ ID NO: 897 - protein, 16 aa, Artificial
  This short-chain peptide was synthetically generated and prepared
  MISC_FEATURE (1)..(1): Modified residue at this position is NMe-V which structurally mimics Valine
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is Norleucine (Nle) which structurally mimics Methionine
  MISC_FEATURE (12)..(12): Modified residue at this position is Homoarginine (Har) which structurally mimics Arginine
  MISC_FEATURE (15)..(15): Modified residue at this position is alpha-Me-Bip(OMe) which structurally mimics Phenyl alanine
  MISC_FEATURE (16)..(16): Modified residue at this position is alpha-Me-APPA which structurally mimics Phenyl alanine
VAVAEIQLMHQRAKFF

SEQ ID NO: 898 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (11)..(11): Modified residue at this position is Homoarginine (Har) which structurally mimics Arginine
  MISC_FEATURE (13)..(13): Modified residue at this position is Homoarginine (Har) which structurally mimics Arginine
  MISC_FEATURE (14)..(14): Modified residue at this position is alpha-Me-Bip(OMe) which structurally mimics Phenyl alanine
  MISC_FEATURE (15)..(15): Modified residue at this position is 2-amino-5-phenylpentanoic acid (APPA) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARAF

SEQ ID NO: 899 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Homoarginine (Har) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARAF

SEQ ID NO: 900 - protein, 15 aa, Artificial
  This short-chain peptide was synthetically generated and prepared
  MISC_FEATURE (1)..(1): Modified residue at this position is alpha-Me-APPA which structurally mimics Phenyl alanine
  MISC_FEATURE (3)..(3): Modified residue at this position is alpha-amino-isobutyric acid (Aib) which structurally mimics Alanine
  MISC_FEATURE (11)..(11): Modified residue at this position is Homoarginine (Har) which structurally mimics Arginine
  MISC_FEATURE (13)..(13): Modified residue at this position is Homoarginine (Har) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 901 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is Norleucine (Nle) which structurally mimics Methionine
  MISC_FEATURE (11)..(11): Modified residue at this position is Homoarginine (Har) which structurally mimics Arginine
  MISC_FEATURE (13)..(13): Modified residue at this position is Homoarginine (Har) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is alpha-Me-APPA which structurally mimics Phenyl alanine
AVAEIQLMHQRARFF

SEQ ID NO: 902 - protein, 16 aa, Artificial
  This short-chain peptide was synthetically generated and prepared
  MISC_FEATURE (2)..(2): Modified residue at this position is alpha-amino-isobutyric acid (Aib) which structurally mimics Alanine
  MISC_FEATURE (4)..(4): Modified residue at this position is alpha-amino-isobutyric acid (Aib) which structurally mimics Alanine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is alpha-Me-Bip(OMe) which structurally mimics Phenyl alanine.
  MISC_FEATURE (16)..(16): Modified residue at this position is 2-amino-5-phenylpentanoic acid (APPA) which structurally mimics Phenyl alanine
VAVAEIQLMHQRARAF

SEQ ID NO: 903 - protein, 16 aa, Artificial
  This short-chain peptide was synthetically generated and prepared
  MISC_FEATURE (2)..(2): Modified residue at this position is alpha-amino-isobutyric acid (Aib) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is Norleucine (Nle) which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is alpha-Me-Bip(OMe) which structurally mimics Phenyl alanine.
  MISC_FEATURE (16)..(16): Modified residue at this position is 2-amino-5-phenylpentanoic acid (APPA) which structurally mimics Phenyl alanine
VAVAEIQLMHQRARAF

SEQ ID NO: 904 - protein, 16 aa, Artificial
  This short-chain peptide was synthetically generated and prepared
  MISC_FEATURE (2)..(2): Modified residue at this position is alpha-amino-isobutyric acid (Aib) which structurally mimics Alanine
  MISC_FEATURE (4)..(4): Modified residue at this position is alpha-amino-isobutyric acid (Aib) which structurally mimics Alanine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is 2'-Ethyl-4'-methoxy-biphenylalanine (Bip(OMe)) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 905 - protein, 16 aa, Artificial
  This short-chain peptide was synthetically generated and prepared
  MISC_FEATURE (2)..(2): Modified residue at this position is alpha-amino-isobutyric acid (Aib) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is Norleucine (Nle) which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is 2'-Ethyl-4'-methoxy-biphenylalanine (Bip(OMe)) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 906 - protein, 16 aa, Artificial
  This short-chain peptide was synthetically generated and prepared
  MISC_FEATURE (1)..(1): Modified residue at this position is alpha-Me-V which structurally mimics Valine
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is 2'-Ethyl-4'-methoxy-biphenylalanine (Bip(OMe)) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 907 - protein, 16 aa, Artificial
  This short-chain peptide was synthetically generated and prepared
  MISC_FEATURE (1)..(1): Modified residue at this position is alpha-Me-V which structurally mimics Valine
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is Norleucine (Nle) which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is 2'-Ethyl-4'-methoxy-biphenylalanine (Bip(OMe)) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 908 - protein, 16 aa, Artificial
  This short-chain peptide was synthetically generated and prepared
  MISC_FEATURE (1)..(1): Modified residue at this position is NMe-V which structurally mimics Valine
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is 2'-Ethyl-4'-methoxy-biphenylalanine (Bip(OMe)) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 909 - protein, 16 aa, Artificial
  This short-chain peptide was synthetically generated and prepared
  MISC_FEATURE (1)..(1): Modified residue at this position is NMe-V which structurally mimics Valine
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is Norleucine (Nle) which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is 2'-Ethyl-4'-methoxy-biphenylalanine (Bip(OMe)) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 910 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is alpha-Me-V which structurally mimics Valine
  MISC_FEATURE (11)..(11): Modified residue at this position is Homoarginine (Har) which structurally mimics Arginine
  MISC_FEATURE (13)..(13): Modified residue at this position is Homoarginine (Har) which structurally mimics Arginine
  MISC_FEATURE (14)..(14): Modified residue at this position is alpha-Me-Bip(OMe) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARAF

SEQ ID NO: 911 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is alpha-MeNle which structurally mimics Methionine
  MISC_FEATURE (11)..(11): Modified residue at this position is Homoarginine (Har) which structurally mimics Arginine
  MISC_FEATURE (13)..(13): Modified residue at this position is Homoarginine (Har) which structurally mimics Arginine
  MISC_FEATURE (14)..(14): Modified residue at this position is alpha-Me-Bip(OMe) which structurally mimics Phenyl alanine.
  MISC_FEATURE (15)..(15): Modified residue at this position is 2-amino-5-phenylpentanoic acid (APPA) which structurally mimics Phenyl alanine
AVAEIQLMHQRARAF

SEQ ID NO: 912 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is alpha-MeNle which structurally mimics Methionine
  MISC_FEATURE (11)..(11): Modified residue at this position is Homoarginine (Har) which structurally mimics Arginine
  MISC_FEATURE (13)..(13): Modified residue at this position is Homoarginine (Har) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is 2-amino-5-phenylpentanoic acid (APPA) which structurally mimics Phenyl alanine
  MISC_FEATURE (15)..(15): Modified residue at this position is alpha-Me-APPA which structurally mimics Phenyl alanine
AVAEIQLMHQRARFF

SEQ ID NO: 913 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is alpha-MeNle which structurally mimics Methionine
  MISC_FEATURE (11)..(11): Modified residue at this position is Homoarginine (Har) which structurally mimics Arginine
  MISC_FEATURE (13)..(13): Modified residue at this position is Homoarginine (Har) which structurally mimics Arginine
  MISC_FEATURE (14)..(14): Modified residue at this position is 2'-Ethyl-4'-methoxy-biphenylalanine (Bip(OMe)) which structurally mimics Phenyl alanine
  MISC_FEATURE (15)..(15): Modified residue at this position is alpha-Me-APPA which structurally mimics Phenyl alanine
AVAEIQLMHQRARFF

SEQ ID NO: 914 - protein, 16 aa, Artificial
  This short-chain peptide was synthetically generated and prepared
  MISC_FEATURE (2)..(2): Modified residue at this position is alpha-amino-isobutyric acid (Aib) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-Me-M which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is alpha-Me-Bip(OMe) which structurally mimics Phenyl alanine.
  MISC_FEATURE (16)..(16): Modified residue at this position is 2-amino-5-phenylpentanoic acid (APPA) which structurally mimics Phenyl alanine
VAVAEIQLMHQRARAF

SEQ ID NO: 915 - protein, 16 aa, Artificial
  This short-chain peptide was synthetically generated and prepared
  MISC_FEATURE (2)..(2): Modified residue at this position is alpha-amino-isobutyric acid (Aib) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-MeNle which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is alpha-Me-Bip(OMe) which structurally mimics Phenyl alanine.
  MISC_FEATURE (16)..(16): Modified residue at this position is 2-amino-5-phenylpentanoic acid (APPA) which structurally mimics Phenyl alanine
VAVAEIQLMHQRARAF

SEQ ID NO: 916 - protein, 16 aa, Artificial
  This short-chain peptide was synthetically generated and prepared
  MISC_FEATURE (2)..(2): Modified residue at this position is 1-amino cyclopropane carboxylic acid (AC3C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-Me-V which structurally mimics Valine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is alpha-Me-Bip(OMe) which structurally mimics Phenyl alanine.
  MISC_FEATURE (16)..(16): Modified residue at this position is 2-amino-5-phenylpentanoic acid (APPA) which structurally mimics Phenyl alanine
VAVAEIQLMHQRARAF

SEQ ID NO: 917 - protein, 16 aa, Artificial
  This short-chain peptide was synthetically generated and prepared
  MISC_FEATURE (2)..(2): Modified residue at this position is 1-amino cyclopropane carboxylic acid (AC3C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-MeNle which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is alpha-Me-Bip(OMe) which structurally mimics Phenyl alanine.
  MISC_FEATURE (16)..(16): Modified residue at this position is 2-amino-5-phenylpentanoic acid (APPA) which structurally mimics Phenyl alanine
VAVAEIQLMHQRARAF

SEQ ID NO: 918 - protein, 16 aa, Artificial
  This short-chain peptide was synthetically generated and prepared
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-MeNle which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is alpha-Me-Bip(OMe) which structurally mimics Phenyl alanine.
  MISC_FEATURE (16)..(16): Modified residue at this position is 2-amino-5-phenylpentanoic acid (APPA) which structurally mimics Phenyl alanine
VAVAEIQLMHQRARAF

SEQ ID NO: 919 - protein, 16 aa, Artificial
  This short-chain peptide was synthetically generated and prepared
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-MeNle which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is 2'-Ethyl-4'-methoxy-biphenylalanine (Bip(OMe)) which structurally mimics Phenyl alanine
  MISC_FEATURE (16)..(16): Modified residue at this position is alpha-Me-APPA which structurally mimics Phenyl alanine
VAVAEIQLMHQRARAF

SEQ ID NO: 920 - protein, 16 aa, Artificial
  This short-chain peptide was synthetically generated and prepared
  MISC_FEATURE (2)..(2): Modified residue at this position is alpha-amino-isobutyric acid (Aib) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-Me-M which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is 2'-Ethyl-4'-methoxy-biphenylalanine (Bip(OMe)) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 921 - protein, 16 aa, Artificial
  This short-chain peptide was synthetically generated and prepared
  MISC_FEATURE (2)..(2): Modified residue at this position is alpha-amino-isobutyric acid (Aib) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-MeNle which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is 2'-Ethyl-4'-methoxy-biphenylalanine (Bip(OMe)) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 922 - protein, 16 aa, Artificial
  This short-chain peptide was synthetically generated and prepared
  MISC_FEATURE (2)..(2): Modified residue at this position is 1-amino cyclopropane carboxylic acid (AC3C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-Me-M which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is 2'-Ethyl-4'-methoxy-biphenylalanine (Bip(OMe)) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 923 - protein, 16 aa, Artificial
  This short-chain peptide was synthetically generated and prepared
  MISC_FEATURE (2)..(2): Modified residue at this position is 1-amino cyclopropane carboxylic acid (AC3C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-MeNle which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is 2'-Ethyl-4'-methoxy-biphenylalanine (Bip(OMe)) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 924 - protein, 16 aa, Artificial
  This short-chain peptide was synthetically generated and prepared
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-Me-M which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is 2'-Ethyl-4'-methoxy-biphenylalanine (Bip(OMe)) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 925 - protein, 16 aa, Artificial
  This short-chain peptide was synthetically generated and prepared
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-MeNle which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is 2'-Ethyl-4'-methoxy-biphenylalanine (Bip(OMe)) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 926 - protein, 16 aa, Artificial
  This short-chain peptide was synthetically generated and prepared
  MISC_FEATURE (1)..(1): Modified residue at this position is alpha-Me-V which structurally mimics Valine
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-MeNle which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is 2'-Ethyl-4'-methoxy-biphenylalanine (Bip(OMe)) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 927 - protein, 16 aa, Artificial
  This short-chain peptide was synthetically generated and prepared
  MISC_FEATURE (1)..(1): Modified residue at this position is alpha-Me-V which structurally mimics Valine
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-MeNle which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is 2'-Ethyl-4'-methoxy-biphenylalanine (Bip(OMe)) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 928 - protein, 16 aa, Artificial
  This short-chain peptide was synthetically generated and prepared
  MISC_FEATURE (1)..(1): Modified residue at this position is NMe-V which structurally mimics Valine
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-Me-M which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is 2'-Ethyl-4'-methoxy-biphenylalanine (Bip(OMe)) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 929 - protein, 16 aa, Artificial
  This short-chain peptide was synthetically generated and prepared
  MISC_FEATURE (1)..(1): Modified residue at this position is NMe-V which structurally mimics Valine
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-MeNle which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is 2'-Ethyl-4'-methoxy-biphenylalanine (Bip(OMe)) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 930 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is alpha-Me-M which structurally mimics Methionine
  MISC_FEATURE (11)..(11): Modified residue at this position is Homoarginine (Har) which structurally mimics Arginine
  MISC_FEATURE (13)..(13): Modified residue at this position is Homoarginine (Har) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 931 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is alpha-MeNle which structurally mimics Methionine
  MISC_FEATURE (11)..(11): Modified residue at this position is Homoarginine (Har) which structurally mimics Arginine
  MISC_FEATURE (13)..(13): Modified residue at this position is Homoarginine (Har) which structurally mimics Arginine
  MISC_FEATURE (14)..(14): Modified residue at this position is alpha-methyl-2,6-diflurophenylalanine (alpha-Me-2,6F-Phe) which structurally mimics Phenyl alanine
  MISC_FEATURE (15)..(15): Modified residue at this position is 2-amino-5-phenylpentanoic acid (APPA) which structurally mimics Phenyl alanine
AVAEIQLMHQRARFF

SEQ ID NO: 932 - protein, 16 aa, Artificial
  This short-chain peptide was synthetically generated and prepared
  MISC_FEATURE (2)..(2): Modified residue at this position is alpha-amino-isobutyric acid (Aib) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-Me-M which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is alpha-methyl-2,6-diflurophenylalanine (alpha-Me-2,6F-Phe) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 933 - protein, 16 aa, Artificial
  This short-chain peptide was synthetically generated and prepared
  MISC_FEATURE (2)..(2): Modified residue at this position is alpha-amino-isobutyric acid (Aib) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-MeNle which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is alpha-methyl-2,6-diflurophenylalanine (alpha-Me-2,6F-Phe) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 934 - protein, 16 aa, Artificial
  This short-chain peptide was synthetically generated and prepared
  MISC_FEATURE (2)..(2): Modified residue at this position is 1-amino cyclopropane carboxylic acid (AC3C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-Me-M which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is alpha-methyl-2,6-diflurophenylalanine (alpha-Me-2,6F-Phe) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 935 - protein, 16 aa, Artificial
  This short-chain peptide was synthetically generated and prepared
  MISC_FEATURE (2)..(2): Modified residue at this position is 1-amino cyclopropane carboxylic acid (AC3C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-MeNle which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is alpha-methyl-2,6-diflurophenylalanine (alpha-Me-2,6F-Phe) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 936 - protein, 16 aa, Artificial
  This short-chain peptide was synthetically generated and prepared
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-Me-M which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is alpha-methyl-2,6-diflurophenylalanine (alpha-Me-2,6F-Phe) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 937 - protein, 16 aa, Artificial
  This short-chain peptide was synthetically generated and prepared
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-MeNle which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is alpha-methyl-2,6-diflurophenylalanine (alpha-Me-2,6F-Phe) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 938 - protein, 16 aa, Artificial
  This short-chain peptide was synthetically generated and prepared
  MISC_FEATURE (1)..(1): Modified residue at this position is alpha-Me-V which structurally mimics Valine
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-Me-M which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is alpha-methyl-2,6-diflurophenylalanine (alpha-Me-2,6F-Phe) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 939 - protein, 16 aa, Artificial
  This short-chain peptide was synthetically generated and prepared
  MISC_FEATURE (1)..(1): Modified residue at this position is alpha-Me-V which structurally mimics Valine
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-MeNle which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is alpha-methyl-2,6-diflurophenylalanine (alpha-Me-2,6F-Phe) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 940 - protein, 16 aa, Artificial
  This short-chain peptide was synthetically generated and prepared
  MISC_FEATURE (1)..(1): Modified residue at this position is NMe-V which structurally mimics Valine
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-Me-M which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is alpha-methyl-2,6-diflurophenylalanine (alpha-Me-2,6F-Phe) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 941 - protein, 16 aa, Artificial
  This short-chain peptide was synthetically generated and prepared
  MISC_FEATURE (1)..(1): Modified residue at this position is NMe-V which structurally mimics Valine
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-MeNle which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is alpha-methyl-2,6-diflurophenylalanine (alpha-Me-2,6F-Phe) which structurally mimics Phenyl alanine
  MISC_FEATURE (16)..(16): Modified residue at this position is alpha-Me-APPA which structurally mimics Phenyl alanine
VAVAEIQLMHQRARFF

SEQ ID NO: 942 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is alpha-Me-M which structurally mimics Methionine
  MISC_FEATURE (11)..(11): Modified residue at this position is Homoarginine (Har) which structurally mimics Arginine
  MISC_FEATURE (13)..(13): Modified residue at this position is Homoarginine (Har) which structurally mimics Arginine
  MISC_FEATURE (14)..(14): Modified residue at this position is alpha-Me-Trp mimics Trp
  MISC_FEATURE (15)..(15): Modified residue at this position is 2-amino-5-phenylpentanoic acid (APPA) which structurally mimics Phenyl alanine
AVAEIQLMHQRARWF

SEQ ID NO: 943 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is alpha-MeNle which structurally mimics Methionine
  MISC_FEATURE (11)..(11): Modified residue at this position is Homoarginine (Har) which structurally mimics Arginine
  MISC_FEATURE (13)..(13): Modified residue at this position is Homoarginine (Har) which structurally mimics Arginine
  MISC_FEATURE (14)..(14): Modified residue at this position is alpha-Me-Trp mimics Trp
  MISC_FEATURE (15)..(15): Modified residue at this position is 2-amino-5-phenylpentanoic acid (APPA) which structurally mimics Phenyl alanine
AVAEIQLMHQRARWF

SEQ ID NO: 944 - protein, 15 aa, Artificial
  This short-chain peptide was synthetically generated and prepared
  MISC_FEATURE (1)..(1): Modified residue at this position is 1-amino cyclopropane carboxylic acid (AC3C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is alpha-Me-M which structurally mimics Methionine
  MISC_FEATURE (11)..(11): Modified residue at this position is Homoarginine (Har) which structurally mimics Arginine
  MISC_FEATURE (13)..(13): Modified residue at this position is Homoarginine (Har) which structurally mimics Arginine
  MISC_FEATURE (14)..(14): Modified residue at this position is alpha-Me-Trp mimics Trp
  MISC_FEATURE (15)..(15): Modified residue at this position is 2-amino-5-phenylpentanoic acid (APPA) which structurally mimics Phenyl alanine
AVAEIQLMHQRARWF

SEQ ID NO: 945 - protein, 15 aa, Artificial
  This short-chain peptide was synthetically generated and prepared
  MISC_FEATURE (1)..(1): Modified residue at this position is 1-amino cyclopropane carboxylic acid (AC3C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is alpha-Me-M which structurally mimics Methionine
  MISC_FEATURE (11)..(11): Modified residue at this position is Homoarginine (Har) which structurally mimics Arginine
  MISC_FEATURE (13)..(13): Modified residue at this position is Homoarginine (Har) which structurally mimics Arginine
  MISC_FEATURE (14)..(14): Modified residue at this position is alpha-Me-Trp mimics Trp
  MISC_FEATURE (15)..(15): Modified residue at this position is 2-amino-5-phenylpentanoic acid (APPA) which structurally mimics Phenyl alanine
AVAEIQLMHQRARWF

SEQ ID NO: 946 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is alpha-Me-M which structurally mimics Methionine
  MISC_FEATURE (11)..(11): Modified residue at this position is Homoarginine (Har) which structurally mimics Arginine
  MISC_FEATURE (13)..(13): Modified residue at this position is Homoarginine (Har) which structurally mimics Arginine
  MISC_FEATURE (14)..(14): Modified residue at this position is alpha-Me-Trp mimics Trp
  MISC_FEATURE (15)..(15): Modified residue at this position is 2-amino-5-phenylpentanoic acid (APPA) which structurally mimics Phenyl alanine
AVAEIQLMHQRARWF

SEQ ID NO: 947 - protein, 15 aa, Artificial
  This short-chain peptide was synthetically generated and prepared
  MISC_FEATURE (1)..(1): Modified residue at this position is 1-amino-cyclopentanecarboxylic acid (AC5C) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is alpha-MeNle which structurally mimics Methionine
  MISC_FEATURE (11)..(11): Modified residue at this position is Homoarginine (Har) which structurally mimics Arginine
  MISC_FEATURE (13)..(13): Modified residue at this position is Homoarginine (Har) which structurally mimics Arginine
  MISC_FEATURE (14)..(14): Modified residue at this position is alpha-Me-Trp mimics Trp
  MISC_FEATURE (15)..(15): Modified residue at this position is 2-amino-5-phenylpentanoic acid (APPA) which structurally mimics Phenyl alanine
AVAEIQLMHQRARWF

SEQ ID NO: 948 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is alpha-Me-M which structurally mimics Methionine
  MISC_FEATURE (11)..(11): Modified residue at this position is Homoarginine (Har) which structurally mimics Arginine
  MISC_FEATURE (13)..(13): Modified residue at this position is Homoarginine (Har) which structurally mimics Arginine
  MISC_FEATURE (14)..(14): Modified residue at this position is alpha-Me-Trp mimics Trp
  MISC_FEATURE (15)..(15): Modified residue at this position is 2-amino-5-phenylpentanoic acid (APPA) which structurally mimics Phenyl alanine
AVAEIQLMHQRARWF

SEQ ID NO: 949 - protein, 15 aa, Artificial
  This short-chain peptide was synthetically generated and prepared
  MISC_FEATURE (1)..(1): Modified residue at this position is alpha-amino-isobutyric acid (Aib) which structurally mimics Alanine
  MISC_FEATURE (3)..(3): Modified residue at this position is alpha-amino-isobutyric acid (Aib) which structurally mimics Alanine
  MISC_FEATURE (8)..(8): Modified residue at this position is alpha-MeNle which structurally mimics Methionine
  MISC_FEATURE (11)..(11): Modified residue at this position is Homoarginine (Har) which structurally mimics Arginine
  MISC_FEATURE (13)..(13): Modified residue at this position is Homoarginine (Har) which structurally mimics Arginine
  MISC_FEATURE (14)..(14): Modified residue at this position is alpha-Me-Trp mimics Trp
  MISC_FEATURE (15)..(15): Modified residue at this position is 2-amino-5-phenylpentanoic acid (APPA) which structurally mimics Phenyl alanine
AVAEIQLMHQRARWF

SEQ ID NO: 950 - protein, 16 aa, Artificial
  This short-chain peptide was synthetically generated and prepared
  MISC_FEATURE (2)..(2): Modified residue at this position is 1-amino cyclopropane carboxylic acid (AC3C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-Me-M which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is alpha-Me-Trp mimics Trp
  MISC_FEATURE (16)..(16): Modified residue at this position is alpha-Me-APPA which structurally mimics Phenyl alanine
VAVAEIQLMHQRARWF

SEQ ID NO: 951 - protein, 16 aa, Artificial
  This short-chain peptide was synthetically generated and prepared
  MISC_FEATURE (2)..(2): Modified residue at this position is 1-amino cyclopropane carboxylic acid (AC3C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-MeNle which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is alpha-Me-Trp mimics Trp
  MISC_FEATURE (16)..(16): Modified residue at this position is alpha-Me-APPA which structurally mimics Phenyl alanine
VAVAEIQLMHQRARWF

SEQ ID NO: 952 - protein, 16 aa, Artificial
  This short-chain peptide was synthetically generated and prepared
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-Me-M which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is alpha-Me-Trp mimics Trp
  MISC_FEATURE (16)..(16): Modified residue at this position is alpha-Me-APPA which structurally mimics Phenyl alanine
VAVAEIQLMHQRARWF

SEQ ID NO: 953 - protein, 16 aa, Artificial
  This short-chain peptide was synthetically generated and prepared
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-MeNle which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is alpha-Me-Trp mimics Trp
  MISC_FEATURE (16)..(16): Modified residue at this position is alpha-Me-APPA which structurally mimics Phenyl alanine
VAVAEIQLMHQRARWF

SEQ ID NO: 954 - protein, 16 aa, Artificial
  This short-chain peptide was synthetically generated and prepared
  MISC_FEATURE (1)..(1): Modified residue at this position is alpha-Me-V which structurally mimics Valine
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-Me-M which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is alpha-Me-Trp mimics Trp
  MISC_FEATURE (16)..(16): Modified residue at this position is alpha-Me-APPA which structurally mimics Phenyl alanine
VAVAEIQLMHQRARWF

SEQ ID NO: 955 - protein, 16 aa, Artificial
  This short-chain peptide was synthetically generated and prepared
  MISC_FEATURE (1)..(1): Modified residue at this position is alpha-Me-V which structurally mimics Valine
  MISC_FEATURE (2)..(2): Modified residue at this position is 1-amino-cyclopentanecarboxylic acid (AC5C) which structurally mimics Alanine
  MISC_FEATURE (4)..(4): Modified residue at this position is alpha-amino-isobutyric acid (Aib) which structurally mimics Alanine
  MISC_FEATURE (9)..(9): Modified residue at this position is alpha-MeNle which structurally mimics Methionine
  MISC_FEATURE (12)..(12): Modified residue at this position is Homoarginine (Har) which structurally mimics Arginine
  MISC_FEATURE (14)..(14): Modified residue at this position is Homoarginine (Har) which structurally mimics Arginine
  MISC_FEATURE (15)..(15): Modified residue at this position is alpha-Me-Trp mimics Trp
  MISC_FEATURE (16)..(16): Modified residue at this position is alpha-Me-APPA which structurally mimics Phenyl alanine
VAVAEIQLMHQRARWF

We claim:

1. An isolated short-chain peptide having a sequence of Formula (I),

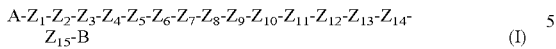 (I)

wherein,
- A represents —NH—$R_1$ or $R_3$—CO—NH—, wherein $R_1$ represents hydrogen, biotin, a substituted linear or branched ($C_{1-18}$) alkyl chain, or an amino acid selected from the group consisting of pyroglutamic acid (Pyr), Pro (P), alpha-methyl-Proline (αMe-P), Val (V), N-methyl-valine (NMe-V), alpha-methyl-Valine (αMe-V), Lys(Biotin), Lys(alkyl), and Lys(acetyl);
- $R_3$ is selected from unsubstituted or substituted linear or branched ($C_{1-18}$) alkyl chain, ($C_{1-6}$)alkoxy, ($C_3$-$C_6$) cycloalkyl, aryl, heteroaryl or arylalkyl groups;
- B represents —$COOR_2$, —$CONHR_2$ or $CH_2OR_2$, wherein $R_2$ represents H or an amino acid selected from the group consisting of Val (V), alpha-methyl-Valine (αMe-V), Lys(Biotin), Lys(alkyl) and Lys(acetyl); each of $Z_1$, $Z_3$ and $Z_{12}$ is the same or different and independently represents a naturally or unnaturally occurring amino acid selected from the group consisting of Ser(S), alpha-methyl-Serine (αMe-S), Val (V), alpha-methyl-Valine (αMe-V), Pro (P), alpha-methyl-Proline (αMe-P), Gly (G), Ala(A), α-amino-isobutyric acid (Aib), 1-amino cyclopropane carboxylic acid ($AC_3C$), 1-amino-cyclopentanecarboxylic acid ($AC_5C$), and 1-amino-cyclohexanecarboxylic acid ($AC_6C$); $Z_2$ represents Val (V) or αMe-Val (αMe-V); each of $Z_4$, $Z_6$ and $Z_{10}$, are the same or different and independently represents a naturally or unnaturally occurring amino acid selected from the group consisting of Glu(E), Homoglutamic acid (HoGlu), 2-amino-4-cyanobutanoic acid (Abu(CN)), Asp (D), Asn(N), Gln(Q), and Aib; each of $Z_5$, $Z_7$ and $Z_9$ is the same or different and independently represents a naturally or unnaturally occurring amino acid selected from the group consisting of Leu (L), Ile (I), Nle (Norleucine), Nva (Norvaline), HoLeu (Homoleucine), Abu(CN), His (H), Phe (F), alpha-methyl-phenylalanine (-α-Me-Phe-), alpha-methyl-2-fluorophenylalanine (-α-Me-2F-Phe-), alpha-methyl-2,6-difluorophenylalanine (-α-Me-2,6-F-Phe-) and 2-fluorophenylalanine (-2F-Phe-) group;
- $Z_8$ represents a naturally or unnaturally occurring amino acid selected from the group consisting of Met, N-methyl-Met ((NMe)M), alpha-methyl-Met (αMe-M), alpha-methyl-Valine (αMe-V), Leu, Nle, N-methyl-Nle ((NMe)Nle), alpha-methyl-Norleucine (αMe-Nle), Nva, HoLeu, Ethionine (EtMet), selenomethionine (SMet), and Val;
- $Z_{11}$ and $Z_{13}$ are the same or different and independently represent a naturally or unnaturally occurring amino acid selected from the group consisting of Aib, Pro(P), αMe-Pro, Lysine (K), Lysine-biotin (K(Biotin)), -Lysine(Nitro) (lys($NO_2$))-, Arginine (R), Arginine(Nitro), (Arg($NO_2$)), Homoarginine (Har), Ornithine (Orn), -Ornithine(Nitro) (Orn($NO_2$)), Citrulline (Cit), Homocitrulline (HoCit), Phe (F), alpha-methyl-phenylalanine (-α-Me-Phe-), alpha-methyl-2-fluorophenylalanine (-α-Me-2F-Phe-) or alpha-methyl-2,6-difluorophenylalanine (-α-Me-2,6-F-Phe-) and 2-fluorophenylalanine (-2F-Phe-);
- $Z_{14}$ represents an amino acid selected from the group consisting of 2'-ethyl-4'-methoxy-biphenylalanine (Bip(OMe)), α-methylated Bip(OMe) [αMe-Bip(OMe)], αMe-Trp, alpha-methyl-phenylalanine (-α-Me-Phe-), alpha-methyl-2-fluorophenylalanine (-α-Me-2F-Phe-), alpha-methyl-2,6-difluorophenylalanine (-α-Me-2,6-F-Phe-) and 2-fluorophenylalanine (-2F-Phe-) groups;
- $Z_{15}$ is present or absent and when present, $Z_{15}$ represents an amino acid selected from the group consisting of 2-amino-5-phenylpentanoic acid (APPA) and 2-amino-2-methyl-5-phenylpentanoic acid (α-Me-APPA).

2. The compound of formula (I) as claimed in claim 1, wherein A represents —NH—$R_1$ or $R_3$—CO—NH—, wherein $R_1$ represents hydrogen, biotin, or an amino acid selected from the group consisting of pyroglutamic acid (Pyr), Pro (P) and Val (V).

3. The compound of formula (I) as claimed in claim 1, wherein $R_3$ is a ($C_{1-18}$) alkyl chain.

4. The compound of formula (I) as claimed in claim 1, wherein B represents —COOR and —$CONHR_2$—, wherein $R_2$ represents H or an amino acid selected from the group consisting of Val (V), alpha-methyl-Valine (αMe-V) and Lys (Biotin).

5. The compound of formula (I) as claimed in claim 1, wherein each of $Z_1$, $Z_3$ and $Z_{12}$ are the same or different and independently represents a naturally or unnaturally occurring amino acids selected from the group consisting of Ala(A), α-amino-isobutyric acid (Aib), 1-amino cyclopropane carboxylic acid ($AC_3C$), 1-amino-cyclopentanecarboxylic acid ($AC_5C$), and 1-amino-cyclohexanecarboxylic acid ($AC_6C$).

6. The compound of formula (I) as claimed in claim 1, wherein $Z_2$ represents Val(V).

7. The compound of formula (I) as claimed in claim 1, wherein each of $Z_4$, $Z_6$ $Z_3$ and $Z_{10}$, are the same or different and independently represent a naturally or unnaturally occurring amino acid selected from the group consisting of Glu(E), Gln(O) and Aib.

8. The compound of formula (I) as claimed in claim 1, wherein each of $Z_5$, $Z_7$ and $Z_9$ are the same or different and independently represent a naturally or unnaturally occurring amino acid selected from the group consisting of Leu (L), Ile (I), Nle, HoLeu (Homoleucine), His (H), alpha-methyl-2-fluorophenylalanine (-α-Me-2F-Phe-) and alpha-methyl-2,6-difluorophenylalanine (-α-Me-2,6-F-Phe-).

9. The compound of formula (I) as claimed in claim 1, wherein $Z_8$ represents a naturally or unnaturally occurring amino acid selected from the group consisting of Met, alpha-methyl-Met (αMe-M), Nle, and N-methyl-Nle ((NMe)Nle).

10. The compound of formula (I) as claimed in claim 1, wherein each of $Z_{11}$ and $Z_{13}$ are the same or different and independently represent a naturally or unnaturally occurring amino acid selected from the group consisting of Aib, αMe-Pro, Lysine (K), Lysine-biotin (K(Biotin)), K($NO_2$), Arginine (R), Arg($NO_2$), Homoarginine (Har), Ornithine (Orn), Orn ($NO_2$), Citrulline (Cit), Homocitrulline (HoCit), alpha-methyl-2-fluorophenylalanine (-α-Me-2F-Phe-) and alpha-methyl-2,6-difluorophenylalanine (-α-Me-2,6-F-Phe-).

11. The compound of formula (I) as claimed in claim 1, wherein $Z_{14}$ represents an amino acid selected from the group consisting of 2'-ethyl-4'-methoxy-biphenylalanine (Bip(OMe)), α-methylated Bip(OMe) [αMe-Bip(OMe)], alpha-methyl-2-fluorophenylalanine (-α-Me-2F-Phe-)-) and alpha-methyl-2,6-difluorophenylalanine (-α-Me-2,6-F-Phe-).

12. The compound of formula (I) as claimed in claim 1, wherein $Z_{15}$ represents an amino acid selected from the group comprising consisting 2-amino-5-phenylpentanoic acid (APPA) and 2-amino-2-methyl-5-phenylpentanoic acid (αMe-APPA).

13. The compound of formula (I) as claimed in claim 1 wherein the aryl group is selected from the group consisting of phenyl, napthyl, indanyl, fluorenyl and biphenylgroups.

14. The compound of formula (I) as claimed in claim 1 wherein the heteroaryl group is selected from pyridyl, thienyl, furyl, imidazolyl, and benzofuranyl groups.

15. The compound of formula (I) as claimed in claim 1, wherein the substituents are selected from the group consisting of hydroxyl, oxo, halo, thio, nitro, amino, alkyl, alkoxy, haloalkyl and haloalkoxy groups.

16. The compoundof formula (I) as claimed in claim 1, $$A\text{-}Z_1\text{-}Z_2\text{-}Z_3\text{-}Z_4\text{-}Z_5\text{-}Z_6\text{-}Z_7\text{-}Z_8\text{-}Z_9\text{-}Z_{10}\text{-}Z_{11}\text{-}Z_{12}\text{-}Z_{13}\text{-}Z_{14}\text{-}Z_{15}\text{-}B \quad (I)$$

wherein A represents —NH—$R_1$ or $R_3$—CO—NH—,
wherein $R_1$ represents hydrogen, biotin or an amino acids elected from pyroglutamic acid (Pyr), Pro (P), and Val (V);
$R_3$ is selected from a substituted linear or branched ($C_{1-18}$) alkyl chain;
B represents —COOR and CONHR$_2$—wherein $R_2$ is as defined in claim 1;
each of $Z_1$, $Z_3$ and $Z_{12}$ are the same or different and independently represents a naturally or unnaturally occurring amino acid selected from the group consisting of Ala(A), α-amino-isobutyric acid and (Aib), 1-amino cyclopropane carboxylic acid (AC$_3$C), 1-amino-cyclopentanecarboxylic acid (AC$_5$C), 1-amino-cyclohexanecarboxylic acid (AC$_6$C); $Z_2$ represents a Val (V); each of $Z_4$, $Z_6$ and $Z_{10}$, are the same or different and independently represent a naturally or unnaturally occurring amino acid selected from the group consisting of Glu(E), Gln(O), and Aib; $Z_5$, $Z_7$ and $Z_9$ are the same or different and independently represent a naturally or unnaturally occurring amino acid selected from the group consisting of Leu (L), Ile (I), Nle, HoLeu (Homoleucine), His (H), alpha-methyl-2-fluorophenylalanine (-α-Me-2F-Phe-), and alpha-methyl-2,6-difluorophenylalanine (-α-Me-2,6-F-Phe-);
$Z_8$ represents a naturally or unnaturally occurring amino acid selected from the group consisting of Met, alpha-methyl-Met (αMe-M), Nle, and N-methyl-Nle ((NMe) Nle);
$Z_{11}$ and $Z_{13}$ are the same or different and independently represent a naturally or unnaturally occurring amino acid selected from the group comprising consisting of Aib, αMe-Pro, Lysine (K), Lysine-biotin (K(Biotin)), K(NO$_2$), Arginine (R), Arg(NO$_2$), Homoarginine (Har), Ornithine (Orn), Orn(NO$_2$), Citrulline (Cit), Homocitrulline (HoCit), alpha-methyl-2-fluorophenylalanine (-α-Me-2F-Phe-), and alpha-methyl-2,6-difluorophenylalanine (-α-Me-2,6-F-Phe-);
$Z_{14}$ represents an amino acid selected from the group consisting of 2'-ethyl-4'-methoxy-biphenylalanine (Bip (OMe)), α-methylated Bip(OMe) [αMe-Bip(OMe)], alpha-methyl-2-fluorophenylalanine (-α-Me-2F-Phe-), and alpha-methyl-2,6-difluorophenylalanine (-α-Me-2,6-F-Phe-);
$Z_{15}$ when present, represents an amino acid selected from the group consisting of 2-amino-5-phenylpentanoic acid (APPA) and 2-amino-2-methyl-5-phenylpentanoic acid (αMe-APPA).

17. The compoundof formula (I) selected from
Aib-V-Aib-EIQLMHQ-Har-AK-(α-Me-Phe);
Aib-V-Aib-EIQL-Nle-HQ-Har-AK-(α-Me-Phe);
Aib-V-Aib-EIQLMHQ-Har-(αMe-Pro)-K-(α-Me-Phe);
Aib-V-Aib-EIQL-Nle-HQ-Har-(αMe-Pro)-K-(α-Me-Phe);
Aib-V-Aib-EIQLMHQ-Har-Aib-K-(α-Me-Phe);
Aib-V-Aib-EIQL-Nle-HQ-Har-Aib-K-(α-Me-Phe);
(AC$_3$C)-V-Aib-EIQL-Nle-HQ-Har-AK-(α-Me-Phe);
(AC$_3$C)-V-Aib-EIQLMHQ-Har-(αMe-Pro)-K-(α-Me-Phe);
(AC$_3$C)-V-Aib-EIQL-Nle-HQ-Har-(αMe-Pro)-K-(α-Me-Phe);
(AC$_3$C)-V-Aib-EIQLMHQ-Har-Aib-K-(α-Me-Phe);
(AC$_3$C)-V-Aib-EIQL-Nle-HQ-Har-Aib-K-(α-Me-Phe);
Aib-V-(AC$_5$C)-EIQLMHQ-Har-Aib-K-(α-Me-Phe);
Aib-V-(AC$_5$C)-EIQL-Nle-HQ-Har-Aib-K-(α-Me-Phe);
(AC$_5$C)-V-(AC$_5$C)-EIQLMHQ-Har-(αMe-Pro)-K-(α-Me-Phe);
(AC$_5$C)-V-(AC$_5$C)-EIQL-Nle-HQ-Har-(αMe-Pro)-K-(α-Me-Phe);
(AC$_5$C)-V-Aib-EIQLMHQ-Har-Aib-K-(α-Me-Phe);
(AC$_5$C)-V-Aib-EIQL-Nle-HQ-Har-Aib-K-(α-Me-Phe);
Aib-V-(AC$_6$C)-EIQLMHQ-Har-Aib-K-(α-Me-Phe);
Aib-V-(AC$_6$C)-EIQL-Nle-HQ-Har-Aib-K-(α-Me-Phe);
Aib-V-Aib-EIQ-(α-Me-2F-Phe)-Nle-HQ-Har-AK-(α-Me-Phe);
Aib-V-Aib-EIQ-(α-Me-2F-Phe)-Nle-HQ-Har-(αMe-Pro)-K-(α-Me-Phe);
Aib-V-Aib-EIQ-(α-Me-2F-Phe)-Nle-HQ-Har-Aib-K-(α-Me-Phe);
(AC$_3$C)-V-Aib-EIQ-(α-Me-2F-Phe)-Nle-HQ-Har-AK-(α-Me-Phe);
(AC$_3$C)-V-Aib-EIQ-(α-Me-2F-Phe)-Nle-HQ-Har-(αMe-Pro)-K-(α-Me-Phe);
(AC$_3$C)-V-Aib-EIQ-(α-Me-2F-Phe)-Nle-HQ-Har-Aib-K-(α-Me-Phe);
Aib-V-(AC$_5$C)-EIQ-(α-Me-2F-Phe)-Nle-HQ-Har-AK-(α-Me-Phe);
Aib-V-(AC$_5$C)-EIQ-(α-Me-2F-Phe)-Nle-HQ-Har-(αMe-Pro)-K-(α-Me-Phe);
Aib-V-(AC$_5$C)-EIQ-(α-Me-2F-Phe)-Nle-HQ-Har-Aib-K-(α-Me-Phe);
(AC$_5$C)-V-(AC$_5$C)-EIQ-(α-Me-2F-Phe)-Nle-HQ-Har-AK-(α-Me-Phe);
(AC$_5$C)-V-(AC$_5$C)-EIQ-(α-Me-2F-Phe)-Nle-HQ-Har-(αMe-Pro)-K-(α-Me-Phe);
(AC$_5$C)-V-(AC$_5$C)-EIQ-(α-Me-2F-Phe)-Nle-HQ-Har-Aib-K-(α-Me-Phe);
Aib-V-Aib-EIQ-(α-Me-2,6-F-Phe)-Nle-HQ-Har-AK-(α-Me-Phe);
Aib-V-Aib-EIQ-(α-Me-2,6-F-Phe)-Nle-HQ-Har-(αMe-Pro)-K-(α-Me-Phe);
Aib-V-Aib-EIQ-(α-Me-2,6-F-Phe)-Nle-HQ-Har-Aib-K-(α-Me-Phe);
(AC$_3$C)-V-Aib-EIQ-(α-Me-2,6-F-Phe)-Nle-HQ-Har-AK-(α-Me-Phe);
(AC$_3$C)-V-Aib-EIQ-(α-Me-2,6-F-Phe)-Nle-HQ-Har-(αMe-Pro)-K-(α-Me-Phe);
(AC$_3$C)-V-Aib-EIQ-(α-Me-2,6-F-Phe)-Nle-HQ-Har-Aib-K-(α-Me-Phe);
Aib-V-(AC$_5$C)-EIQ-(α-Me-2,6-F-Phe)-Nle-HQ-Har-AK-(α-Me-Phe);
Aib-V-(AC$_5$C)-EIQ-(α-Me-2,6-F-Phe)-Nle-HQ-Har-(αMe-Pro)-K-(α-Me-Phe);
Aib-V-(AC$_5$C)-EIQ-(α-Me-2,6-F-Phe)-Nle-HQ-Har-Aib-K-(α-Me-Phe);
(AC$_5$C)-V-(AC$_5$C)-EIQ-(α-Me-2,6-F-Phe)-Nle-HQ-Har-AK-(α-Me-Phe);
(AC$_5$C)-V-(AC$_5$C)-EIQ-(α-Me-2,6-F-Phe)-Nle-HQ-Har-(αMe-Pro)-K-(α-Me-Phe);

(AC₅C)-V-(AC₅C)-EIQ-(α-Me-2,6-F-Phe)-Nle-HQ-Har-Aib-K-(α-Me-Phe);
(AC₅C)-V-(AC₅C)-EIQ-(α-Me-2,6-F-Phe)-Nle-H-(Abu(CN))-Har-AK-(α-Me-Phe);
(AC₅C)-V-Aib-EIQ-(α-Me-2,6-F-Phe)-Nle-HQ-Har-AK-(α-Me-Phe);
(AC₅C)-V-Aib-EIQ-(α-Me-2,6-F-Phe)-Nle-HQ-Har-(αMe-Pro)-K-(α-Me-Phe);
(AC₅C)-V-Aib-EIQ-(α-Me-2,6-F-Phe)-Nle-HQ-Har-Aib-K-(α-Me-Phe);
(AC₅C)-V-(AC₅C)-EIQ-(α-Me-2,6-F-Phe)-M-HQ-Har-AK-(α-Me-Phe);
(AC₅C)-V-(AC₅C)-EIQ-(α-Me-2,6-F-Phe)-M-HQ-Har-(αMe-Pro)-K-(α-Me-Phe);
(AC₅C)-V-(AC₅C)-EIQ-(α-Me-2,6-F-Phe)-M-HQ-Har-Aib-K-(α-Me-Phe);
Aib-V-Aib-EIQ-(α-Me-2F-Phe)-Nle-HQ-Har-AK-(α-Me-2F-Phe);
Aib-V-Aib-EIQ-(α-Me-2F-Phe)-Nle-HQ-Har-(αMe-Pro)-K-(α-Me-2F-Phe);
Aib-V-Aib-EIQ-(α-Me-2F-Phe)-Nle-HQ-Har-Aib-K-(α-Me-2F-Phe);
(AC₃C)-V-Aib-EIQ-(α-Me-2F-Phe)-Nle-HQ-Har-AK-(α-Me-2F-Phe);
(AC₃C)-V-Aib-EIQ-(α-Me-2F-Phe)-Nle-HQ-Har-(αMe-Pro)-K-(α-Me-2F-Phe);
(AC₃C)-V-Aib-EIQ-(α-Me-2F-Phe)-Nle-HQ-Har-Aib-K-(α-Me-2F-Phe);
Aib-V-(AC₅C)-EIQ-(α-Me-2F-Phe)-Nle-HQ-Har-AK-(α-Me-2F-Phe);
Aib-V-(AC₅C)-EIQ-(α-Me-2F-Phe)-Nle-HQ-Har-(αMe-Pro)-K-(α-Me-2F-Phe);
Aib-V-(AC₅C)-EIQ-(α-Me-2F-Phe)-Nle-HQ-Har-Aib-K-(α-Me-2F-Phe);
(AC₅C)-V-(AC₅C)-EIQ-(α-Me-2F-Phe)-Nle-HQ-Har-AK-(α-Me-2F-Phe);
(AC₅C)-V-(AC₅C)-EIQ-(α-Me-2F-Phe)-Nle-HQ-Har-(αMe-Pro)-K-(α-Me-2F-Phe);
(AC₅C)-V-(AC₅C)-EIQ-(α-Me-2F-Phe)-Nle-HQ-Har-Aib-K-(α-Me-2F-Phe);
(AC₅C)-V-Aib-EIQ-(α-Me-2F-Phe)-Nle-HQ-Har-AK-(α-Me-2F-Phe);
(AC₅C)-V-Aib-EIQ-(α-Me-2F-Phe)-Nle-HQ-Har-(αMe-Pro)-K-(α-Me-2F-Phe);
(AC₅C)-V-Aib-EIQ-(α-Me-2F-Phe)-Nle-HQ-Har-Aib-K-(α-Me-2F-Phe);
Aib-V-Aib-EIQ-(α-Me-2,6-F-Phe)-Nle-HQ-Har-A-K(Biotin)-(α-Me-2F-Phe);
Aib-V-Aib-EIQ-(α-Me-2,6-F-Phe)-Nle-HQ-Har-AK-(α-Me-2F-Phe);
Aib-V-Aib-EIQ-(α-Me-2,6-F-Phe)-Nle-HQ-Har-(αMe-Pro)-K-(α-Me-2F-Phe);
Aib-V-Aib-EIQ-(α-Me-2,6-F-Phe)-Nle-HQ-Har-Aib-K-(α-Me-2F-Phe);
(AC₃C)-V-Aib-EIQ-(α-Me-2,6-F-Phe)-Nle-HQ-Har-AK-(α-Me-2F-Phe);
(AC₃C)-V-Aib-EIQ-(α-Me-2,6-F-Phe)-Nle-HQ-Har-(αMe-Pro)-K-(α-Me-2F-Phe);
(AC₃C)-V-Aib-EIQ-(α-Me-2,6-F-Phe)-Nle-HQ-Har-Aib-K-(α-Me-2F-Phe);
Aib-V-(AC₅C)-EIQ-(α-Me-2,6-F-Phe)-Nle-HQ-Har-AK-(α-Me-2F-Phe);
Aib-V-(AC₅C)-EIQ-(α-Me-2,6-F-Phe)-Nle-HQ-Har-(αMe-Pro)-K-(α-Me-2F-Phe);
Aib-V-(AC₅C)-EIQ-(α-Me-2,6-F-Phe)-Nle-HQ-Har-Aib-K-(α-Me-2F-Phe);
(AC₅C)-V-(AC₅C)-EIQ-(α-Me-2,6-F-Phe)-Nle-HQ-Har-AK-(α-Me-2F-Phe);
(AC₅C)-V-(AC₅C)-EIQ-(α-Me-2,6-F-Phe)-Nle-HQ-Har-(αMe-Pro)-K-(α-Me-2F-Phe);
(AC₅C)-V-(AC₅C)-EIQ-(α-Me-2,6-F-Phe)-Nle-HQ-Har-Aib-K-(α-Me-2F-Phe);
(AC₅C)-V-Aib-EIQ-(α-Me-2,6-F-Phe)-Nle-HQ-Har-AK-(α-Me-2F-Phe);
(AC₅C)-V-Aib-EIQ-(α-Me-2,6-F-Phe)-Nle-HQ-Har-(αMe-Pro)-K-(α-Me-2F-Phe);
(AC₅C)-V-Aib-EIQ-(α-Me-2,6-F-Phe)-Nle-HQ-Har-Aib-K-(α-Me-2F-Phe);
(AC₅C)-V-Aib-EIQ-(α-Me-2,6-F-Phe)-Nle-H-(Abu(CN))-Har-AK-(α-Me-2F-Phe);
Aib-V-(AC₆C)-EIQ-(α-Me-2,6-F-Phe)-Nle-HQ-Har-AK-(α-Me-2F-Phe);
Aib-V-(AC₆C)-EIQ-(α-Me-2,6-F-Phe)-Nle-HQ-Har-(αMe-Pro)-K-(α-Me-2F-Phe);
Aib-V-(AC₆C)-EIQ-(α-Me-2,6-F-Phe)-Nle-HQ-Har-Aib-K-(α-Me-2F-Phe);
Aib-V-Aib-EIQ-(α-Me-2F-Phe)-Nle-HQ-Har-AK-(α-Me-2,6-F-Phe);
Aib-V-Aib-EIQ-(α-Me-2F-Phe)-Nle-HQ-Har-(αMe-Pro)-K-(α-Me-2,6-F-Phe);
Aib-V-Aib-EIQ-(α-Me-2F-Phe)-Nle-HQ-Har-Aib-K-(α-Me-2,6-F-Phe);
(AC₃C)-V-Aib-EIQ-(α-Me-2F-Phe)-Nle-HQ-Har-AK-(α-Me-2,6-F-Phe);
(AC₃C)-V-Aib-EIQ-(α-Me-2F-Phe)-Nle-HQ-Har-(αMe-Pro)-K-(α-Me-2,6-F-Phe);
(AC₃C)-V-Aib-EIQ-(α-Me-2F-Phe)-Nle-HQ-Har-Aib-K-(α-Me-2,6-F-Phe);
Aib-V-(AC₅C)-EIQ-(α-Me-2F-Phe)-Nle-HQ-Har-AK-(α-Me-2,6-F-Phe);
Aib-V-(AC₅C)-EIQ-(α-Me-2F-Phe)-Nle-HQ-Har-(αMe-Pro)-K-(α-Me-2,6-F-Phe);
Aib-V-(AC₅C)-EIQ-(α-Me-2F-Phe)-Nle-HQ-Har-Aib-K-(α-Me-2,6-F-Phe);
(AC₅C)-V-(AC₅C)-EIQ-(α-Me-2F-Phe)-Nle-HQ-Har-AK-(α-Me-2,6-F-Phe);
(AC₅C)-V-(AC₅C)-EIQ-(α-Me-2F-Phe)-Nle-HQ-Har-(αMe-Pro)-K-(α-Me-2,6-F-Phe);
(AC₅C)-V-(AC₅C)-EIQ-(α-Me-2F-Phe)-Nle-HQ-Har-Aib-K-(α-Me-2,6-F-Phe);
(AC₅C)-V-Aib-EIQ-(α-Me-2F-Phe)-Nle-HQ-Har-AK-(α-Me-2,6-F-Phe);
(AC₅C)-V-Aib-EIQ-(α-Me-2F-Phe)-Nle-HQ-Har-(αMe-Pro)-K-(α-Me-2,6-F-Phe);
(AC₅C)-V-Aib-EIQ-(α-Me-2F-Phe)-Nle-HQ-Har-Aib-K-(α-Me-2,6-F-Phe);
Aib-V-Aib-EIQ-(α-Me-2,6-F-Phe)-Nle-HQ-Har-A-K(Biotin)-(α-Me-2,6-F-Phe);
Aib-V-Aib-EIQ-(α-Me-2,6-F-Phe)-Nle-HQ-Har-AK-(α-Me-2,6-F-Phe);
Aib-V-Aib-EIQ-(α-Me-2,6-F-Phe)-Nle-HQ-Har-(αMe-Pro)-K-(α-Me-2,6-F-Phe);
Aib-V-Aib-EIQ-(α-Me-2,6-F-Phe)-Nle-HQ-Har-Aib-K-(α-Me-2,6-F-Phe);
(AC₃C)-V-Aib-EIQ-(α-Me-2,6-F-Phe)-Nle-HQ-Har-AK-(α-Me-2,6-F-Phe);
(AC₃C)-V-Aib-EIQ-(α-Me-2,6-F-Phe)-Nle-HQ-Har-(αMe-Pro)-K-(α-Me-2,6-F-Phe);
(AC₃C)-V-Aib-EIQ-(α-Me-2,6-F-Phe)-Nle-HQ-Har-Aib-K-(α-Me-2,6-F-Phe);
Aib-V-(AC₅C)-EIQ-(α-Me-2,6-F-Phe)-Nle-HQ-Har-AK-(α-Me-2,6-F-Phe);

Aib-V-(AC₅C)-EIQ-(α-Me-2,6-F-Phe)-Nle-HQ-Har-(αMe-Pro)-K-(α-Me-2,6-F-Phe);
Aib-V-(AC₅C)-EIQ-(α-Me-2,6-F-Phe)-Nle-HQ-Har-Aib-K-(α-Me-2,6-F-Phe);
(AC₅C)-V-(AC₅C)-EIQ-(α-Me-2,6-F-Phe)-Nle-HQ-Har-AK-(α-Me-2,6-F-Phe);
(AC₅C)-V-(AC₅C)-EIQ-(α-Me-2,6-F-Phe)-Nle-HQ-Har-(αMe-Pro)-K-(α-Me-2,6-F-Phe);
(AC₅C)-V-(AC₅C)-EIQ-(α-Me-2,6-F-Phe)-Nle-HQ-Har-Aib-K-(α-Me-2,6-F-Phe);
(AC₅C)-V-Aib-EIQ-(α-Me-2,6-F-Phe)-Nle-HQ-Har-AK-(α-Me-2,6-F-Phe);
(AC₅C)-V-Aib-EIQ-(α-Me-2,6-F-Phe)-Nle-HQ-Har-(αMe-Pro)-K-(α-Me-2,6-F-Phe);
(AC₅C)-V-Aib-EIQ-(α-Me-2,6-F-Phe)-Nle-HQ-Har-Aib-K-(α-Me-2,6-F-Phe);
Aib-V-Aib-EIQ-(α-Me-2F-Phe)-Nle-HQ-Har-A-Cit-(α-Me-2F-Phe);
Aib-V-Aib-EIQ-(α-Me-2F-Phe)-Nle-HQ-Har-Aib-Cit-(α-Me-2F-Phe);
(AC₃C)-V-Aib-EIQ-(α-Me-2F-Phe)-Nle-HQ-Har-A-Cit-(α-Me-2F-Phe);
(AC₃C)-V-Aib-EIQ-(α-Me-2F-Phe)-Nle-HQ-Har-Aib-Cit-(α-Me-2F-Phe);
Aib-V-(AC₅C)-EIQ-(α-Me-2F-Phe)-Nle-HQ-Har-A-Cit-(α-Me-2F-Phe);
Aib-V-(AC₅C)-EIQ-(α-Me-2F-Phe)-Nle-HQ-Har-Aib-Cit-(α-Me-2F-Phe);
(AC₅C)-V-(AC₅C)-EIQ-(α-Me-2F-Phe)-Nle-HQ-Har-A-Cit-(α-Me-2F-Phe);
(AC₅C)-V-(AC₅C)-EIQ-(α-Me-2F-Phe)-Nle-HQ-Har-Aib-Cit-(α-Me-2F-Phe);
(AC₅C)-V-Aib-EIQ-(α-Me-2F-Phe)-Nle-HQ-Har-A-Cit-(α-Me-2F-Phe);
(AC₅C)-V-Aib-EIQ-(α-Me-2F-Phe)-Nle-HQ-Har-Aib-Cit-(α-Me-2F-Phe);
Aib-V-Aib-EIQ-(α-Me-2,6-F-Phe)-Nle-HQ-Har-A-Cit-(α-Me-2F-Phe);
Aib-V-Aib-EIQ-(α-Me-2,6-F-Phe)-Nle-HQ-Har-Aib-Cit-(α-Me-2F-Phe);
(AC₃C)-V-Aib-EIQ-(α-Me-2,6-F-Phe)-Nle-HQ-Har-A-Cit-(α-Me-2F-Phe);
(AC₃C)-V-Aib-EIQ-(α-Me-2,6-F-Phe)-Nle-HQ-Har-Aib-Cit-(α-Me-2F-Phe);
Aib-V-(AC₅C)-EIQ-(α-Me-2,6-F-Phe)-Nle-HQ-Har-A-Cit-(α-Me-2F-Phe);
Aib-V-(AC₅C)-EIQ-(α-Me-2,6-F-Phe)-Nle-HQ-Har-Aib-Cit-(α-Me-2F-Phe);
(AC₅C)-V-(AC₅C)-EIQ-(α-Me-2,6-F-Phe)-Nle-HQ-Har-A-Cit-(α-Me-2F-Phe);
(AC₅C)-V-(AC₅C)-EIQ-(α-Me-2,6-F-Phe)-Nle-HQ-Har-Aib-Cit-(α-Me-2F-Phe);
(AC₅C)-V-Aib-EIQ-(α-Me-2,6-F-Phe)-Nle-HQ-Har-A-Cit-(α-Me-2F-Phe);
(AC₅C)-V-Aib-EIQ-(α-Me-2,6-F-Phe)-Nle-HQ-Har-Aib-Cit-(α-Me-2F-Phe);
Aib-V-Aib-EIQ-(α-Me-2F-Phe)-Nle-HQ-Har-A-Cit-(α-Me-2,6-F-Phe);
Aib-V-Aib-EIQ-(α-Me-2F-Phe)-Nle-HQ-Har-Aib-Cit-(α-Me-2,6-F-Phe);
(AC₃C)-V-Aib-EIQ-(α-Me-2F-Phe)-Nle-HQ-Har-A-Cit-(α-Me-2,6-F-Phe);
(AC₃C)-V-Aib-EIQ-(α-Me-2F-Phe)-Nle-HQ-Har-Aib-Cit-(α-Me-2,6-F-Phe);
Aib-V-(AC₅C)-EIQ-(α-Me-2F-Phe)-Nle-HQ-Har-A-Cit-(α-Me-2,6-F-Phe);
Aib-V-(AC₅C)-EIQ-(α-Me-2F-Phe)-Nle-HQ-Har-Aib-Cit-(α-Me-2,6-F-Phe);
(AC₅C)-V-(AC₅C)-EIQ-(α-Me-2F-Phe)-Nle-HQ-Har-A-Cit-(α-Me-2,6-F-Phe);
(AC₅C)-V-(AC₅C)-EIQ-(α-Me-2F-Phe)-Nle-HQ-Har-Aib-Cit-(α-Me-2,6-F-Phe);
(AC₅C)-V-Aib-EIQ-(α-Me-2F-Phe)-Nle-HQ-Har-A-Cit-(α-Me-2,6-F-Phe);
(AC₅C)-V-Aib-EIQ-(α-Me-2F-Phe)-Nle-HQ-Har-Aib-Cit-(α-Me-2,6-F-Phe);
Aib-V-Aib-EIQ-(α-Me-2,6-F-Phe)-Nle-HQ-Har-A-Cit-(α-Me-2,6-F-Phe);
Aib-V-Aib-EIQ-(α-Me-2,6-F-Phe)-Nle-HQ-Har-Aib-Cit-(α-Me-2,6-F-Phe);
(AC₃C)-V-Aib-EIQ-(α-Me-2,6-F-Phe)-Nle-HQ-Har-A-Cit-(α-Me-2,6-F-Phe);
(AC₃C)-V-Aib-EIQ-(α-Me-2,6-F-Phe)-Nle-HQ-Har-Aib-Cit-(α-Me-2,6-F-Phe);
Aib-V-(AC₅C)-EIQ-(α-Me-2,6-F-Phe)-Nle-HQ-Har-A-Cit-(α-Me-2,6-F-Phe);
Aib-V-(AC₅C)-EIQ-(α-Me-2,6-F-Phe)-Nle-HQ-Har-Aib-Cit-(α-Me-2,6-F-Phe);
(AC₅C)-V-(AC₅C)-EIQ-(α-Me-2,6-F-Phe)-Nle-HQ-Har-A-Cit-(α-Me-2,6-F-Phe);
(AC₅C)-V-(AC₅C)-EIQ-(α-Me-2,6-F-Phe)-Nle-HQ-Har-Aib-Cit-(α-Me-2,6-F-Phe);
(AC₅C)-V-Aib-EIQ-(α-Me-2,6-F-Phe)-Nle-HQ-Har-A-Cit-(α-Me-2,6-F-Phe);
(AC₅C)-V-Aib-EIQ-(α-Me-2,6-F-Phe)-Nle-HQ-Har-Aib-Cit-(α-Me-2,6-F-Phe);
Aib-V-Aib-EIQ-(α-Me-2F-Phe)-Nle-HQ-Har-A-Aib-(α-Me-2F-Phe);
Aib-V-Aib-EIQ-(α-Me-2F-Phe)-Nle-HQ-Har-Aib-Aib-(α-Me-2F-Phe);
(AC₃C)-V-Aib-EIQ-(α-Me-2F-Phe)-Nle-HQ-Har-A-Aib-(α-Me-2F-Phe);
(AC₃C)-V-Aib-EIQ-(α-Me-2F-Phe)-Nle-HQ-Har-Aib-Aib-(α-Me-2F-Phe);
Aib-V-(AC₅C)-EIQ-(α-Me-2F-Phe)-Nle-HQ-Har-A-Aib-(α-Me-2F-Phe);
Aib-V-(AC₅C)-EIQ-(α-Me-2F-Phe)-Nle-HQ-Har-Aib-Aib-(α-Me-2F-Phe);
(AC₅C)-V-(AC₅C)-EIQ-(α-Me-2F-Phe)-Nle-HQ-Har-A-Aib-(α-Me-2F-Phe);
(AC₅C)-V-(AC₅C)-EIQ-(α-Me-2F-Phe)-Nle-HQ-Har-Aib-Aib-(α-Me-2F-Phe);
(AC₅C)-V-Aib-EIQ-(α-Me-2F-Phe)-Nle-HQ-Har-A-Aib-(α-Me-2F-Phe);
(AC₅C)-V-Aib-EIQ-(α-Me-2F-Phe)-Nle-HQ-Har-Aib-Aib-(α-Me-2F-Phe);
Aib-V-Aib-EIQ-(α-Me-2,6-F-Phe)-Nle-HQ-Har-A-Aib-(α-Me-2F-Phe);
Aib-V-Aib-EIQ-(α-Me-2,6-F-Phe)-Nle-HQ-Har-Aib-Aib-(α-Me-2F-Phe);
(AC₃C)-V-Aib-EIQ-(α-Me-2,6-F-Phe)-Nle-HQ-Har-A-Aib-(α-Me-2F-Phe);
(AC₃C)-V-Aib-EIQ-(α-Me-2,6-F-Phe)-Nle-HQ-Har-Aib-Aib-(α-Me-2F-Phe);
Aib-V-(AC₅C)-EIQ-(α-Me-2,6-F-Phe)-Nle-HQ-Har-A-Aib-(α-Me-2F-Phe);
Aib-V-(AC₅C)-EIQ-(α-Me-2,6-F-Phe)-Nle-HQ-Har-Aib-Aib-(α-Me-2F-Phe);
(AC₅C)-V-(AC₅C)-EIQ-(α-Me-2,6-F-Phe)-Nle-HQ-Har-A-Aib-(α-Me-2F-Phe);
(AC₅C)-V-(AC₅C)-EIQ-(α-Me-2,6-F-Phe)-Nle-HQ-Har-Aib-Aib-(α-Me-2F-Phe);

(AC₅C)-V-Aib-EIQ-(α-Me-2,6-F-Phe)-Nle-HQ-Har-A-Aib-(α-Me-2F-Phe);
(AC₅C)-V-Aib-EIQ-(α-Me-2,6-F-Phe)-Nle-HQ-Har-Aib-Aib-(α-Me-2F-Phe);
Aib-V-Aib-EIQ-(α-Me-2F-Phe)-Nle-HQ-Har-A-Aib-(α-Me-2,6-F-Phe);
Aib-V-Aib-EIQ-(α-Me-2F-Phe)-Nle-HQ-Har-Aib-Aib-(α-Me-2,6-F-Phe);
(AC₃C)-V-Aib-EIQ-(α-Me-2F-Phe)-Nle-HQ-Har-A-Aib-(α-Me-2,6-F-Phe);
(AC₃C)-V-Aib-EIQ-(α-Me-2F-Phe)-Nle-HQ-Har-Aib-Aib-(α-Me-2,6-F-Phe);
Aib-V-(AC₅C)-EIQ-(α-Me-2F-Phe)-Nle-HQ-Har-A-Aib-(α-Me-2,6-F-Phe);
Aib-V-(AC₅C)-EIQ-(α-Me-2F-Phe)-Nle-HQ-Har-Aib-Aib-(α-Me-2,6-F-Phe);
(AC₅C)-V-(AC₅C)-EIQ-(α-Me-2F-Phe)-Nle-HQ-Har-A-Aib-(α-Me-2,6-F-Phe);
(AC₅C)-V-(AC₅C)-EIQ-(α-Me-2F-Phe)-Nle-HQ-Har-Aib-Aib-(α-Me-2,6-F-Phe);
(AC₅C)-V-Aib-EIQ-(α-Me-2F-Phe)-Nle-HQ-Har-A-Aib-(α-Me-2,6-F-Phe);
(AC₅C)-V-Aib-EIQ-(α-Me-2F-Phe)-Nle-HQ-Har-Aib-(α-Me-2,6-F-Phe);
Aib-V-Aib-EIQ-(α-Me-2,6-F-Phe)-Nle-HQ-Har-A-Aib-(α-Me-2,6-F-Phe);
Aib-V-Aib-EIQ-(α-Me-2,6-F-Phe)-Nle-HQ-Har-Aib-Aib-(α-Me-2,6-F-Phe);
(AC₃C)-V-Aib-EIQ-(α-Me-2,6-F-Phe)-Nle-HQ-Har-A-Aib-(α-Me-2,6-F-Phe);
(AC₃C)-V-Aib-EIQ-(α-Me-2,6-F-Phe)-Nle-HQ-Har-Aib-Aib-(α-Me-2,6-F-Phe);
Aib-V-(AC₅C)-EIQ-(α-Me-2,6-F-Phe)-Nle-HQ-Har-A-Aib-(α-Me-2,6-F-Phe);
Aib-V-(AC₅C)-EIQ-(α-Me-2,6-F-Phe)-Nle-HQ-Har-Aib-Aib-(α-Me-2,6-F-Phe);
(AC₅C)-V-(AC₅C)-EIQ-(α-Me-2,6-F-Phe)-Nle-HQ-Har-A-Aib-(α-Me-2,6-F-Phe);
(AC₅C)-V-(AC₅C)-EIQ-(α-Me-2,6-F-Phe)-Nle-HQ-Har-Aib-Aib-(α-Me-2,6-F-Phe);
(AC₅C)-V-Aib-EIQ-(α-Me-2,6-F-Phe)-Nle-HQ-Har-A-Aib-(α-Me-2,6-F-Phe);
(AC₅C)-V-Aib-EIQ-(α-Me-2,6-F-Phe)-Nle-HQ-Har-Aib-(α-Me-2,6-F-Phe);
Aib-V-Aib-EIQ-(α-Me-2F-Phe)-Nle-HQ-Har-A-(α-Me-2,6-F-Phe)-(α-Me-2F-Phe);
Aib-V-Aib-EIQ-(α-Me-2F-Phe)-Nle-HQ-Har-Aib-(α-Me-2,6-F-Phe)-(α-Me-2F-Phe);
(AC₃C)-V-Aib-EIQ-(α-Me-2F-Phe)-Nle-HQ-Har-A-(α-Me-2,6-F-Phe)-(α-Me-2F-Phe);
(AC₃C)-V-Aib-EIQ-(α-Me-2F-Phe)-Nle-HQ-Har-Aib-(α-Me-2,6-F-Phe)-(α-Me-2F-Phe);
Aib-V-(AC₅C)-EIQ-(α-Me-2F-Phe)-Nle-HQ-Har-A-(α-Me-2,6-F-Phe)-(α-Me-2F-Phe);
Aib-V-(AC₅C)-EIQ-(α-Me-2F-Phe)-Nle-HQ-Har-Aib-(α-Me-2,6-F-Phe)-(α-Me-2F-Phe);
(AC₅C)-V-(AC₅C)-EIQ-(α-Me-2F-Phe)-Nle-HQ-Har-A-(α-Me-2,6-F-Phe)-(α-Me-2F-Phe);
(AC₅C)-V-(AC₅C)-EIQ-(α-Me-2F-Phe)-Nle-HQ-Har-Aib-(α-Me-2,6-F-Phe)-(α-Me-2F-Phe);
(AC₅C)-V-Aib-EIQ-(α-Me-2F-Phe)-Nle-HQ-Har-A-(α-Me-2,6-F-Phe)-(α-Me-2F-Phe);
(AC₅C)-V-Aib-EIQ-(α-Me-2F-Phe)-Nle-HQ-Har-Aib-(α-Me-2,6-F-Phe)-(α-Me-2F-Phe);
Aib-V-Aib-EIQ-(α-Me-2,6-F-Phe)-Nle-HQ-Har-A-(α-Me-2,6-F-Phe)-(α-Me-2F-Phe);

Aib-V-Aib-EIQ-(α-Me-2,6-F-Phe)-Nle-HQ-Har-Aib-(α-Me-2,6-F-Phe)-(α-Me-2F-Phe);
(AC₃C)-V-Aib-EIQ-(α-Me-2,6-F-Phe)-Nle-HQ-Har-A-(α-Me-2,6-F-Phe)-(α-Me-2F-Phe);
(AC₃C)-V-Aib-EIQ-(α-Me-2,6-F-Phe)-Nle-HQ-Har-Aib-(α-Me-2,6-F-Phe)-(α-Me-2F-Phe);
Aib-V-(AC₅C)-EIQ-(α-Me-2,6-F-Phe)-Nle-HQ-Har-A-(α-Me-2,6-F-Phe)-(α-Me-2F-Phe);
Aib-V-(AC₅C)-EIQ-(α-Me-2,6-F-Phe)-Nle-HQ-Har-Aib-(α-Me-2,6-F-Phe)-(α-Me-2F-Phe);
(AC₅C)-V-(AC₅C)-EIQ-(α-Me-2,6-F-Phe)-Nle-HQ-Har-A-(α-Me-2,6-F-Phe)-(α-Me-2F-Phe);
(AC₅C)-V-(AC₅C)-EIQ-(α-Me-2,6-F-Phe)-Nle-HQ-Har-Aib-(α-Me-2,6-F-Phe)-(α-Me-2F-Phe);
(AC₅C)-V-Aib-EIQ-(α-Me-2,6-F-Phe)-Nle-HQ-Har-A-(α-Me-2,6-F-Phe)-(α-Me-2F-Phe);
(AC₅C)-V-Aib-EIQ-(α-Me-2,6-F-Phe)-Nle-HQ-Har-Aib-(α-Me-2,6-F-Phe)-(α-Me-2F-Phe);
Aib-V-Aib-EIQ-(α-Me-2,6-F-Phe)-Nle-HQ-Har-A-(α-Me-2,6-F-Phe)-(α-Me-2,6-F-Phe);
Aib-V-Aib-EIQ-(α-Me-2,6-F-Phe)-Nle-HQ-Har-Aib-(α-Me-2,6-F-Phe)-(α-Me-2,6-F-Phe);
(AC₃C)-V-Aib-EIQ-(α-Me-2,6-F-Phe)-Nle-HQ-Har-A-(α-Me-2,6-F-Phe)-(α-Me-2,6-F-Phe);
(AC₃C)-V-Aib-EIQ-(α-Me-2,6-F-Phe)-Nle-HQ-Har-Aib-(α-Me-2,6-F-Phe)-(α-Me-2,6-F-Phe);
Aib-V-(AC₅C)-EIQ-(α-Me-2,6-F-Phe)-Nle-HQ-Har-A-(α-Me-2,6-F-Phe)-(α-Me-2,6-F-Phe);
Aib-V-(AC₅C)-EIQ-(α-Me-2,6-F-Phe)-Nle-HQ-Har-Aib-(α-Me-2,6-F-Phe)-(α-Me-2,6-F-Phe);
(AC₅C)-V-(AC₅C)-EIQ-(α-Me-2,6-F-Phe)-Nle-HQ-Har-A-(α-Me-2,6-F-Phe)-(α-Me-2,6-F-Phe);
(AC₅C)-V-(AC₅C)-EIQ-(α-Me-2,6-F-Phe)-Nle-HQ-Har-Aib-(α-Me-2,6-F-Phe)-(α-Me-2,6-F-Phe);
(AC₅C)-V-Aib-EIQ-(α-Me-2,6-F-Phe)-Nle-HQ-Har-A-(α-Me-2,6-F-Phe)-(α-Me-2,6-F-Phe);
(AC₅C)-V-Aib-EIQ-(α-Me-2,6-F-Phe)-Nle-HQ-Har-Aib-(α-Me-2,6-F-Phe)-(α-Me-2,6-F-Phe);
Aib-V-Aib-EIQ-(α-Me-2F-Phe)-Nle-HQ-Har-A-Arg(NO₂)-(α-Me-2F-Phe);
Aib-V-Aib-EIQ-(α-Me-2F-Phe)-Nle-HQ-Har-Aib-Arg(NO₂)-(α-Me-2F-Phe);
(AC₃C)-V-Aib-EIQ-(α-Me-2F-Phe)-Nle-HQ-Har-A-Arg(NO₂)-(α-Me-2F-Phe);
(AC₃C)-V-Aib-EIQ-(α-Me-2F-Phe)-Nle-HQ-Har-Aib-Arg(NO₂)-(α-Me-2F-Phe);

Aib-V-(AC$_5$C)-EIQ-(α-Me-2F-Phe)-Nle-HQ-Har-A-Arg(NO$_2$)-(α-Me-2F-Phe);
Aib-V-(AC$_5$C)-EIQ-(α-Me-2F-Phe)-Nle-HQ-Har-Aib-Arg(NO$_2$)-(α-Me-2F-Phe);
(AC$_5$C)-V-(AC$_5$C)-EIQ-(α-Me-2F-Phe)-Nle-HQ-Har-A-Arg(NO$_2$)-(α-Me-2F-Phe);
(AC$_5$C)-V-(AC$_5$C)-EIQ-(α-Me-2F-Phe)-Nle-HQ-Har-Aib-Arg(NO$_2$)-(α-Me-2F-Phe);
(AC$_5$C)-V-Aib-EIQ-(α-Me-2F-Phe)-Nle-HQ-Har-A-Arg(NO$_2$)-(α-Me-2F-Phe);
(AC$_5$C)-V-Aib-EIQ-(α-Me-2F-Phe)-Nle-HQ-Har-Aib-Arg(NO$_2$)-(α-Me-2F-Phe);
Aib-V-Aib-EIQ-(α-Me-2,6-F-Phe)-Nle-HQ-Har-A-Arg(NO$_2$)-(α-Me-2F-Phe);
Aib-V-Aib-EIQ-(α-Me-2,6-F-Phe)-Nle-HQ-Har-Aib-Arg(NO$_2$)-(α-Me-2F-Phe);
(AC$_3$C)-V-Aib-EIQ-(α-Me-2,6-F-Phe)-Nle-HQ-Har-A-Arg(NO$_2$)-(α-Me-2F-Phe);
(AC$_3$C)-V-Aib-EIQ-(α-Me-2,6-F-Phe)-Nle-HQ-Har-Aib-Arg(NO$_2$)-(α-Me-2F-Phe);
Aib-V-(AC$_5$C)-EIQ-(α-Me-2,6-F-Phe)-Nle-HQ-Har-A-Arg(NO$_2$)-(α-Me-2F-Phe);
Aib-V-(AC$_5$C)-EIQ-(α-Me-2,6-F-Phe)-Nle-HQ-Har-Aib-Arg(NO$_2$)-(α-Me-2F-Phe);
(AC$_5$C)-V-(AC$_5$C)-EIQ-(α-Me-2,6-F-Phe)-Nle-HQ-Har-A-Arg(NO$_2$)-(α-Me-2F-Phe);
(AC$_5$C)-V-(AC$_5$C)-EIQ-(α-Me-2,6-F-Phe)-Nle-HQ-Har-Aib-Arg(NO$_2$)-(α-Me-2F-Phe);
(AC$_5$C)-V-Aib-EIQ-(α-Me-2,6-F-Phe)-Nle-HQ-Har-A-Arg(NO$_2$)-(α-Me-2F-Phe);
(AC$_5$C)-V-Aib-EIQ-(α-Me-2,6-F-Phe)-Nle-HQ-Har-Aib-Arg(NO$_2$)-(α-Me-2F-Phe);
Aib-V-Aib-EIQ-(α-Me-2F-Phe)-Nle-HQ-Har-A-Arg(NO$_2$)-(α-Me-2,6-F-Phe);
Aib-V-Aib-EIQ-(α-Me-2F-Phe)-Nle-HQ-Har-Aib-Arg(NO$_2$)-(α-Me-2,6-F-Phe);
(AC$_3$C)-V-Aib-EIQ-(α-Me-2F-Phe)-Nle-HQ-Har-A-Arg(NO$_2$)-(α-Me-2,6-F-Phe);
(AC$_3$C)-V-Aib-EIQ-(α-Me-2F-Phe)-Nle-HQ-Har-Aib-Arg(NO$_2$)-(α-Me-2,6-F-Phe);
Aib-V-(AC$_5$C)-EIQ-(α-Me-2F-Phe)-Nle-HQ-Har-A-Arg(NO$_2$)-(α-Me-2,6-F-Phe);
Aib-V-(AC$_5$C)-EIQ-(α-Me-2F-Phe)-Nle-HQ-Har-Aib-Arg(NO$_2$)-(α-Me-2,6-F-Phe);
(AC$_5$C)-V-(AC$_5$C)-EIQ-(α-Me-2F-Phe)-Nle-HQ-Har-A-Arg(NO$_2$)-(α-Me-2,6-F-Phe);
(AC$_5$C)-V-(AC$_5$C)-EIQ-(α-Me-2F-Phe)-Nle-HQ-Har-Aib-Arg(NO$_2$)-(α-Me-2,6-F-Phe);
(AC$_5$C)-V-Aib-EIQ-(α-Me-2F-Phe)-Nle-HQ-Har-A-Arg(NO$_2$)-(α-Me-2,6-F-Phe);
(AC$_5$C)-V-Aib-EIQ-(α-Me-2F-Phe)-Nle-HQ-Har-Aib-Arg(NO$_2$)— (α-Me-2,6-F-Phe);
Aib-V-Aib-EIQ-(α-Me-2,6-F-Phe)-Nle-HQ-Har-A-Arg(NO$_2$)-(α-Me-2,6-F-Phe);
Aib-V-Aib-EIQ-(α-Me-2,6-F-Phe)-Nle-HQ-Har-Aib-Arg(NO$_2$)-(α-Me-2,6-F-Phe);
(AC$_3$C)-V-Aib-EIQ-(α-Me-2,6-F-Phe)-Nle-HQ-Har-A-Arg(NO$_2$)-(α-Me-2,6-F-Phe);
(AC$_3$C)-V-Aib-EIQ-(α-Me-2,6-F-Phe)-Nle-HQ-Har-Aib-Arg(NO$_2$)-(α-Me-2,6-F-Phe);
Aib-V-(AC$_5$C)-EIQ-(α-Me-2,6-F-Phe)-Nle-HQ-Har-A-Arg(NO$_2$)-(α-Me-2,6-F-Phe);
Aib-V-(AC$_5$C)-EIQ-(α-Me-2,6-F-Phe)-Nle-HQ-Har-Aib-Arg(NO$_2$)-(α-Me-2,6-F-Phe);
(AC$_5$C)-V-(AC$_5$C)-EIQ-(α-Me-2,6-F-Phe)-Nle-HQ-Har-A-Arg(NO$_2$)-(α-Me-2,6-F-Phe);
(AC$_5$C)-V-(AC$_5$C)-EIQ-(α-Me-2,6-F-Phe)-Nle-HQ-Har-Aib-Arg(NO$_2$)-(α-Me-2,6-F-Phe);
(AC$_5$C)-V-Aib-EIQ-(α-Me-2,6-F-Phe)-Nle-HQ-Har-A-Arg(NO$_2$)-(α-Me-2,6-F-Phe);
(AC$_5$C)-V-Aib-EIQ-(α-Me-2,6-F-Phe)-Nle-HQ-Har-Aib-Arg(NO$_2$)-(α-Me-2,6-F-Phe);
Aib-V-Aib-EIQ-(α-Me-2F-Phe)-Nle-HQ-Orn-A-Cit-(α-Me-2F-Phe);
Aib-V-Aib-EIQ-(α-Me-2F-Phe)-Nle-HQ-Orn-Aib-Cit-(α-Me-2F-Phe);
(AC$_5$C)-V-Aib-EIQ-(α-Me-2F-Phe)-Nle-HQ-Orn-A-Cit-(α-Me-2F-Phe);
(AC$_5$C)-V-Aib-EIQ-(α-Me-2F-Phe)-Nle-HQ-Orn-Aib-Cit-(α-Me-2F-Phe);
Aib-V-Aib-EIQ-(α-Me-2,6-F-Phe)-Nle-HQ-Orn-A-Cit-(α-Me-2F-Phe);
Aib-V-Aib-EIQ-(α-Me-2,6-F-Phe)-Nle-HQ-Orn-Aib-Cit-(α-Me-2F-Phe);
(AC$_5$C)-V-Aib-EIQ-(α-Me-2,6-F-Phe)-Nle-HQ-Orn-A-Cit-(α-Me-2F-Phe);
(AC$_5$C)-V-Aib-EIQ-(α-Me-2,6-F-Phe)-Nle-HQ-Orn-Aib-Cit-(α-Me-2F-Phe);
Aib-V-Aib-EIQ-(α-Me-2F-Phe)-Nle-HQ-Orn-A-Cit-(α-Me-2,6-F-Phe);
Aib-V-Aib-EIQ-(α-Me-2F-Phe)-Nle-HQ-Orn-Aib-Cit-(α-Me-2,6-F-Phe);
(AC$_5$C)-V-Aib-EIQ-(α-Me-2F-Phe)-Nle-HQ-Orn-A-Cit-(α-Me-2,6-F-Phe);
(AC$_5$C)-V-Aib-EIQ-(α-Me-2F-Phe)-Nle-HQ-Orn-Aib-Cit-(α-Me-2,6-F-Phe);
Aib-V-Aib-EIQ-(α-Me-2,6-F-Phe)-Nle-HQ-Orn-A-Cit-(α-Me-2,6-F-Phe);
Aib-V-Aib-EIQ-(α-Me-2,6-F-Phe)-Nle-HQ-Orn-Aib-Cit-(α-Me-2,6-F-Phe);
(AC$_5$C)-V-Aib-EIQ-(α-Me-2,6-F-Phe)-Nle-HQ-Orn-A-Cit-(α-Me-2,6-F-Phe);
(AC$_5$C)-V-Aib-EIQ-(α-Me-2,6-F-Phe)-Nle-HQ-Orn-Aib-Cit-(α-Me-2,6-F-Phe);
Aib-V-Aib-EIQ-(α-Me-2F-Phe)-Nle-HQ-Orn-A-Aib-(α-Me-2F-Phe);
Aib-V-Aib-EIQ-(α-Me-2F-Phe)-Nle-HQ-Orn-Aib-Aib-(α-Me-2F-Phe);
(AC$_5$C)-V-Aib-EIQ-(α-Me-2F-Phe)-Nle-HQ-Orn-A-Aib-(α-Me-2F-Phe);
(AC$_5$C)-V-Aib-EIQ-(α-Me-2F-Phe)-Nle-HQ-Orn-Aib-Aib-(α-Me-2F-Phe);
Aib-V-Aib-EIQ-(α-Me-2,6-F-Phe)-Nle-HQ-Orn-A-Aib-(α-Me-2F-Phe);
Aib-V-Aib-EIQ-(α-Me-2,6-F-Phe)-Nle-HQ-Orn-Aib-Aib-(α-Me-2F-Phe);
(AC$_5$C)-V-Aib-EIQ-(α-Me-2,6-F-Phe)-Nle-HQ-Orn-A-Aib-(α-Me-2F-Phe);
(AC$_5$C)-V-Aib-EIQ-(α-Me-2,6-F-Phe)-Nle-HQ-Orn-Aib-Aib-(α-Me-2F-Phe);
Aib-V-Aib-EIQ-(α-Me-2F-Phe)-Nle-HQ-Orn-A-Aib-(α-Me-2,6-F-Phe);
Aib-V-Aib-EIQ-(α-Me-2F-Phe)-Nle-HQ-Orn-Aib-Aib-(α-Me-2,6-F-Phe);
(AC$_5$C)-V-Aib-EIQ-(α-Me-2F-Phe)-Nle-HQ-Orn-A-Aib-(α-Me-2,6-F-Phe);
(AC$_5$C)-V-Aib-EIQ-(α-Me-2F-Phe)-Nle-HQ-Orn-Aib-Aib-(α-Me-2,6-F-Phe);
Aib-V-Aib-EIQ-(α-Me-2,6-F-Phe)-Nle-HQ-Orn-A-Aib-(α-Me-2,6-F-Phe);
Aib-V-Aib-EIQ-(α-Me-2,6-F-Phe)-Nle-HQ-Orn-Aib-Aib-(α-Me-2,6-F-Phe);

(AC$_5$C)-V-Aib-EIQ-(α-Me-2,6-F-Phe)-Nle-HQ-Orn-A-Aib-(α-Me-2,6-F-Phe);
(AC$_5$C)-V-Aib-EIQ-(α-Me-2,6-F-Phe)-Nle-HQ-Orn-Aib-Aib-(α-Me-2,6-F-Phe);
Aib-V-Aib-EIQ-(α-Me-2F-Phe)-Nle-HQ-Orn-A-(α-Me-2,6-F-Phe)-(α-Me-2F-Phe);
Aib-V-Aib-EIQ-(α-Me-2F-Phe)-Nle-HQ-Orn-Aib-(α-Me-2,6-F-Phe)-(α-Me-2F-Phe);
(AC$_5$C)-V-Aib-EIQ-(α-Me-2F-Phe)-Nle-HQ-Orn-A-(α-Me-2,6-F-Phe)-(α-Me-2F-Phe);
(AC$_5$C)-V-Aib-EIQ-(α-Me-2F-Phe)-Nle-HQ-Orn-Aib-(α-Me-2,6-F-Phe)-(α-Me-2F-Phe);
Aib-V-Aib-EIQ-(α-Me-2,6-F-Phe)-Nle-HQ-Orn-A-(α-Me-2,6-F-Phe)-(α-Me-2F-Phe);
Aib-V-Aib-EIQ-(α-Me-2,6-F-Phe)-Nle-HQ-Orn-Aib-(α-Me-2,6-F-Phe)-(α-Me-2F-Phe);
(AC$_5$C)-V-Aib-EIQ-(α-Me-2,6-F-Phe)-Nle-HQ-Orn-A-(α-Me-2,6-F-Phe)-(α-Me-2F-Phe);
(AC$_5$C)-V-Aib-EIQ-(α-Me-2,6-F-Phe)-Nle-HQ-Orn-Aib-(α-Me-2,6-F-Phe)-(α-Me-2F-Phe);
Aib-V-Aib-EIQ-(α-Me-2F-Phe)-Nle-HQ-Orn-A-(α-Me-2,6-F-Phe)-(α-Me-2,6-F-Phe);
Aib-V-Aib-EIQ-(α-Me-2F-Phe)-Nle-HQ-Orn-Aib-(α-Me-2,6-F-Phe)-(α-Me-2,6-F-Phe);
(AC$_5$C)-V-Aib-EIQ-(α-Me-2F-Phe)-Nle-HQ-Orn-A-(α-Me-2,6-F-Phe)-(α-Me-2,6-F-Phe);
(AC$_5$C)-V-Aib-EIQ-(α-Me-2F-Phe)-Nle-HQ-Orn-Aib-(α-Me-2,6-F-Phe)-(α-Me-2,6-F-Phe);
Aib-V-Aib-EIQ-(α-Me-2,6-F-Phe)-Nle-HQ-Orn-A-(α-Me-2,6-F-Phe)-(α-Me-2,6-F-Phe);
Aib-V-Aib-EIQ-(α-Me-2,6-F-Phe)-Nle-HQ-Orn-Aib-(α-Me-2,6-F-Phe)-(α-Me-2,6-F-Phe);
(AC$_5$C)-V-Aib-EIQ-(α-Me-2,6-F-Phe)-Nle-HQ-Orn-A-(α-Me-2,6-F-Phe)-(α-Me-2,6-F-Phe);
(AC$_5$C)-V-Aib-EIQ-(α-Me-2,6-F-Phe)-Nle-HQ-Orn-Aib-(α-Me-2,6-F-Phe)-(α-Me-2,6-F-Phe);
Aib-V-Aib-EIQ-(α-Me-2F-Phe)-Nle-HQ-Orn-A-Arg(NO$_2$)-(α-Me-2F-Phe);
Aib-V-Aib-EIQ-(α-Me-2F-Phe)-Nle-HQ-Orn-Aib-Arg(NO$_2$)-(α-Me-2F-Phe);
(AC$_5$C)-V-Aib-EIQ-(α-Me-2F-Phe)-Nle-HQ-Orn-A-Arg(NO$_2$)-(α-Me-2F-Phe);
(AC$_5$C)-V-Aib-EIQ-(α-Me-2F-Phe)-Nle-HQ-Orn-Aib-Arg(NO$_2$)-(α-Me-2F-Phe);
Aib-V-Aib-EIQ-(α-Me-2,6-F-Phe)-Nle-HQ-Orn-A-Arg(NO$_2$)-(α-Me-2F-Phe);
Aib-V-Aib-EIQ-(α-Me-2,6-F-Phe)-Nle-HQ-Orn-Aib-Arg(NO$_2$)-(α-Me-2F-Phe);
(AC$_5$C)-V-Aib-EIQ-(α-Me-2,6-F-Phe)-Nle-HQ-Orn-A-Arg(NO$_2$)-(α-Me-2F-Phe);
(AC$_5$C)-V-Aib-EIQ-(α-Me-2,6-F-Phe)-Nle-HQ-Orn-Aib-Arg(NO$_2$)-(α-Me-2F-Phe);
Aib-V-Aib-EIQ-(α-Me-2F-Phe)-Nle-HQ-Orn-A-Arg(NO$_2$)-(α-Me-2,6-F-Phe);
Aib-V-Aib-EIQ-(α-Me-2F-Phe)-Nle-HQ-Orn-Aib-Arg(NO$_2$)-(α-Me-2,6-F-Phe);
(AC$_5$C)-V-Aib-EIQ-(α-Me-2F-Phe)-Nle-HQ-Orn-A-Arg(NO$_2$)-(α-Me-2,6-F-Phe);
(AC$_5$C)-V-Aib-EIQ-(α-Me-2F-Phe)-Nle-HQ-Orn-Aib-Arg(NO$_2$)-(α-Me-2,6-F-Phe);
Aib-V-Aib-EIQ-(α-Me-2,6-F-Phe)-Nle-HQ-Orn-A-Arg(NO$_2$)-(α-Me-2,6-F-Phe);
Aib-V-Aib-EIQ-(α-Me-2,6-F-Phe)-Nle-HQ-Orn-Aib-Arg(NO$_2$)-(α-Me-2,6-F-Phe);
(AC$_5$C)-V-Aib-EIQ-(α-Me-2,6-F-Phe)-Nle-HQ-Orn-A-Arg(NO$_2$)-(α-Me-2,6-F-Phe);
(AC$_5$C)-V-Aib-EIQ-(α-Me-2,6-F-Phe)-Nle-HQ-Orn-Aib-Arg(NO$_2$)-(α-Me-2,6-F-Phe);
Aib-V-Aib-EIQ-(α-Me-2F-Phe)-Nle-HQ-Cit-A-Cit-(α-Me-2F-Phe);
Aib-V-Aib-EIQ-(α-Me-2F-Phe)-Nle-HQ-Cit-Aib-Cit-(α-Me-2F-Phe);
(AC$_5$C)-V-Aib-EIQ-(α-Me-2F-Phe)-Nle-HQ-Cit-A-Cit-(α-Me-2F-Phe);
(AC$_5$C)-V-Aib-EIQ-(α-Me-2F-Phe)-Nle-HQ-Cit-Aib-Cit-(α-Me-2F-Phe);
Aib-V-Aib-EIQ-(α-Me-2,6-F-Phe)-Nle-HQ-Cit-A-Cit-(α-Me-2F-Phe);
Aib-V-Aib-EIQ-(α-Me-2,6-F-Phe)-Nle-HQ-Cit-Aib-Cit-(α-Me-2F-Phe);
(AC$_5$C)-V-Aib-EIQ-(α-Me-2,6-F-Phe)-Nle-HQ-Cit-A-Cit-(α-Me-2F-Phe);
(AC$_5$C)-V-Aib-EIQ-(α-Me-2,6-F-Phe)-Nle-HQ-Cit-Aib-Cit-(α-Me-2F-Phe);
Aib-V-Aib-EIQ-(α-Me-2F-Phe)-Nle-HQ-Cit-A-Cit-(α-Me-2,6-F-Phe);
Aib-V-Aib-EIQ-(α-Me-2F-Phe)-Nle-HQ-Cit-Aib-Cit-(α-Me-2,6-F-Phe);
(AC$_5$C)-V-Aib-EIQ-(α-Me-2F-Phe)-Nle-HQ-Cit-A-Cit-(α-Me-2,6-F-Phe);
(AC$_5$C)-V-Aib-EIQ-(α-Me-2F-Phe)-Nle-HQ-Cit-Aib-Cit-(α-Me-2,6-F-Phe);
Aib-V-Aib-EIQ-(α-Me-2,6-F-Phe)-Nle-HQ-Cit-A-Cit-(α-Me-2,6-F-Phe);
Aib-V-Aib-EIQ-(α-Me-2,6-F-Phe)-Nle-HQ-Cit-Aib-Cit-(α-Me-2,6-F-Phe);
(AC$_5$C)-V-Aib-EIQ-(α-Me-2,6-F-Phe)-Nle-HQ-Cit-A-Cit-(α-Me-2,6-F-Phe);
(AC$_5$C)-V-Aib-EIQ-(α-Me-2,6-F-Phe)-Nle-HQ-Cit-Aib-Cit-(α-Me-2,6-F-Phe);
Aib-V-Aib-EIQ-(α-Me-2F-Phe)-Nle-HQ-Cit-A-Aib-(α-Me-2F-Phe);
Aib-V-Aib-EIQ-(α-Me-2F-Phe)-Nle-HQ-Cit-Aib-Aib-(α-Me-2F-Phe);
(AC$_5$C)-V-Aib-EIQ-(α-Me-2F-Phe)-Nle-HQ-Cit-A-Aib-(α-Me-2F-Phe);
(AC$_5$C)-V-Aib-EIQ-(α-Me-2F-Phe)-Nle-HQ-Cit-Aib-Aib-(α-Me-2F-Phe);
Aib-V-Aib-EIQ-(α-Me-2,6-F-Phe)-Nle-HQ-Cit-A-Aib-(α-Me-2F-Phe);
Aib-V-Aib-EIQ-(α-Me-2,6-F-Phe)-Nle-HQ-Cit-Aib-Aib-(α-Me-2F-Phe);
(AC$_5$C)-V-Aib-EIQ-(α-Me-2,6-F-Phe)-Nle-HQ-Cit-A-Aib-(α-Me-2F-Phe);
(AC$_5$C)-V-Aib-EIQ-(α-Me-2,6-F-Phe)-Nle-HQ-Cit-Aib-Aib-(α-Me-2F-Phe);
Aib-V-Aib-EIQ-(α-Me-2F-Phe)-Nle-HQ-Cit-A-Aib-(α-Me-2,6-F-Phe);
Aib-V-Aib-EIQ-(α-Me-2F-Phe)-Nle-HQ-Cit-Aib-Aib-(α-Me-2,6-F-Phe);
(AC$_5$C)-V-Aib-EIQ-(α-Me-2F-Phe)-Nle-HQ-Cit-A-Aib-(α-Me-2,6-F-Phe);
(AC$_5$C)-V-Aib-EIQ-(α-Me-2F-Phe)-Nle-HQ-Cit-Aib-Aib-(α-Me-2,6-F-Phe);
Aib-V-Aib-EIQ-(α-Me-2,6-F-Phe)-Nle-HQ-Cit-A-Aib-(α-Me-2,6-F-Phe);
Aib-V-Aib-EIQ-(α-Me-2,6-F-Phe)-Nle-HQ-Cit-Aib-Aib-(α-Me-2,6-F-Phe);
(AC$_5$C)-V-Aib-EIQ-(α-Me-2,6-F-Phe)-Nle-HQ-Cit-A-Aib-(α-Me-2,6-F-Phe);
(AC$_5$C)-V-Aib-EIQ-(α-Me-2,6-F-Phe)-Nle-HQ-Cit-Aib-Aib-(α-Me-2,6-F-Phe);

Aib-V-Aib-EIQ-(α-Me-2F-Phe)-Nle-HQ-Cit-A-(α-Me-2,6-F-Phe)-(α-Me-2F-Phe);
Aib-V-Aib-EIQ-(α-Me-2F-Phe)-Nle-HQ-Cit-Aib-(α-Me-2,6-F-Phe)-(α-Me-2F-Phe);
(AC₅C)-V-Aib-EIQ-(α-Me-2F-Phe)-Nle-HQ-Cit-A-(α-Me-2,6-F-Phe)-(α-Me-2F-Phe);
(AC₅C)-V-Aib-EIQ-(α-Me-2F-Phe)-Nle-HQ-Cit-Aib-(α-Me-2,6-F-Phe)-(α-Me-2F-Phe);
Aib-V-Aib-EIQ-(α-Me-2,6-F-Phe)-Nle-HQ-Cit-A-(α-Me-2,6-F-Phe)-(α-Me-2F-Phe);
Aib-V-Aib-EIQ-(α-Me-2,6-F-Phe)-Nle-HQ-Cit-Aib-(α-Me-2,6-F-Phe)-(α-Me-2F-Phe);
(AC₅C)-V-Aib-EIQ-(α-Me-2,6-F-Phe)-Nle-HQ-Cit-A-(α-Me-2,6-F-Phe)-(α-Me-2F-Phe);
(AC₅C)-V-Aib-EIQ-(α-Me-2,6-F-Phe)-Nle-HQ-Cit-Aib-(α-Me-2,6-F-Phe)-(α-Me-2F-Phe);
Aib-V-Aib-EIQ-(α-Me-2F-Phe)-Nle-HQ-Cit-A-(α-Me-2,6-F-Phe)-(α-Me-2,6-F-Phe);
Aib-V-Aib-EIQ-(α-Me-2F-Phe)-Nle-HQ-Cit-Aib-(α-Me-2,6-F-Phe)-(α-Me-2,6-F-Phe);
(AC₅C)-V-Aib-EIQ-(α-Me-2F-Phe)-Nle-HQ-Cit-A-(α-Me-2,6-F-Phe)-(α-Me-2,6-F-Phe);
(AC₅C)-V-Aib-EIQ-(α-Me-2F-Phe)-Nle-HQ-Cit-Aib-(α-Me-2,6-F-Phe)-(α-Me-2,6-F-Phe);
Aib-V-Aib-EIQ-(α-Me-2,6-F-Phe)-Nle-HQ-Cit-A-(α-Me-2,6-F-Phe)-(α-Me-2,6-F-Phe);
Aib-V-Aib-EIQ-(α-Me-2,6-F-Phe)-Nle-HQ-Cit-Aib-(α-Me-2,6-F-Phe)-(α-Me-2,6-F-Phe);
(AC₅C)-V-Aib-EIQ-(α-Me-2,6-F-Phe)-Nle-HQ-Cit-A-(α-Me-2,6-F-Phe)-(α-Me-2,6-F-Phe);
(AC₅C)-V-Aib-EIQ-(α-Me-2,6-F-Phe)-Nle-HQ-Cit-Aib-(α-Me-2,6-F-Phe)-(α-Me-2,6-F-Phe);
Aib-V-Aib-EIQ-(α-Me-2F-Phe)-Nle-HQ-Cit-A-Arg(NO₂)-(α-Me-2F-Phe);
Aib-V-Aib-EIQ-(α-Me-2F-Phe)-Nle-HQ-Cit-Aib-Arg(NO₂)-(α-Me-2F-Phe);
(AC₅C)-V-Aib-EIQ-(α-Me-2F-Phe)-Nle-HQ-Cit-A-Arg(NO₂)-(α-Me-2F-Phe);
(AC₅C)-V-Aib-EIQ-(α-Me-2F-Phe)-Nle-HQ-Cit-Aib-Arg(NO₂)-(α-Me-2F-Phe);
Aib-V-Aib-EIQ-(α-Me-2,6-F-Phe)-Nle-HQ-Cit-A-Arg(NO₂)-(α-Me-2F-Phe);
Aib-V-Aib-EIQ-(α-Me-2,6-F-Phe)-Nle-HQ-Cit-Aib-Arg(NO₂)-(α-Me-2F-Phe);
(AC₅C)-V-Aib-EIQ-(α-Me-2,6-F-Phe)-Nle-HQ-Cit-A-Arg(NO₂)-(α-Me-2F-Phe);
(AC₅C)-V-Aib-EIQ-(α-Me-2,6-F-Phe)-Nle-HQ-Cit-Aib-Arg(NO₂)-(α-Me-2F-Phe);
Aib-V-Aib-EIQ-(α-Me-2F-Phe)-Nle-HQ-Cit-A-Arg(NO₂)-(α-Me-2,6-F-Phe);
Aib-V-Aib-EIQ-(α-Me-2F-Phe)-Nle-HQ-Cit-Aib-Arg(NO₂)-(α-Me-2,6-F-Phe);
(AC₅C)-V-Aib-EIQ-(α-Me-2F-Phe)-Nle-HQ-Cit-A-Arg(NO₂)-(α-Me-2,6-F-Phe);
(AC₅C)-V-Aib-EIQ-(α-Me-2F-Phe)-Nle-HQ-Cit-Aib-Arg(NO₂)-(α-Me-2,6-F-Phe);
Aib-V-Aib-EIQ-(α-Me-2,6-F-Phe)-Nle-HQ-Cit-A-Arg(NO₂)-(α-Me-2,6-F-Phe);
Aib-V-Aib-EIQ-(α-Me-2,6-F-Phe)-Nle-HQ-Cit-Aib-Arg(NO₂)-(α-Me-2,6-F-Phe);
(AC₅C)-V-Aib-EIQ-(α-Me-2,6-F-Phe)-Nle-HQ-Cit-A-Arg(NO₂)-(α-Me-2,6-F-Phe);
(AC₅C)-V-Aib-EIQ-(α-Me-2,6-F-Phe)-Nle-HQ-Cit-Aib-Arg(NO₂)-(α-Me-2,6-F-Phe);
Aib-V-Aib-EIQ-(α-Me-2F-Phe)-Nle-HQ-(HoCit)-A-Cit-(α-Me-2F-Phe);
Aib-V-Aib-EIQ-(α-Me-2F-Phe)-Nle-HQ-(HoCit)-Aib-Cit-(α-Me-2F-Phe);
(AC₅C)-V-Aib-EIQ-(α-Me-2F-Phe)-Nle-HQ-(HoCit)-A-Cit-(α-Me-2F-Phe);
(AC₅C)-V-Aib-EIQ-(α-Me-2F-Phe)-Nle-HQ-(HoCit)-Aib-Cit-(α-Me-2F-Phe);
Aib-V-Aib-EIQ-(α-Me-2,6-F-Phe)-Nle-HQ-(HoCit)-A-Cit-(α-Me-2F-Phe);
Aib-V-Aib-EIQ-(α-Me-2,6-F-Phe)-Nle-HQ-(HoCit)-Aib-Cit-(α-Me-2F-Phe);
(AC₅C)-V-Aib-EIQ-(α-Me-2,6-F-Phe)-Nle-HQ-(HoCit)-A-Cit-(α-Me-2F-Phe);
(AC₅C)-V-Aib-EIQ-(α-Me-2,6-F-Phe)-Nle-HQ-(HoCit)-Aib-Cit-(α-Me-2F-Phe);
Aib-V-Aib-EIQ-(α-Me-2F-Phe)-Nle-HQ-(HoCit)-A-Cit-(α-Me-2,6-F-Phe);
Aib-V-Aib-EIQ-(α-Me-2F-Phe)-Nle-HQ-(HoCit)-Aib-Cit-(α-Me-2,6-F-Phe);
(AC₅C)-V-Aib-EIQ-(α-Me-2F-Phe)-Nle-HQ-(HoCit)-A-Cit-(α-Me-2,6-F-Phe);
(AC₅C)-V-Aib-EIQ-(α-Me-2F-Phe)-Nle-HQ-(HoCit)-Aib-Cit-(α-Me-2,6-F-Phe);
Aib-V-Aib-EIQ-(α-Me-2,6-F-Phe)-Nle-HQ-(HoCit)-A-Cit-(α-Me-2,6-F-Phe);
Aib-V-Aib-EIQ-(α-Me-2,6-F-Phe)-Nle-HQ-(HoCit)-Aib-Cit-(α-Me-2,6-F-Phe);
(AC₅C)-V-Aib-EIQ-(α-Me-2,6-F-Phe)-Nle-HQ-(HoCit)-A-Cit-(α-Me-2,6-F-Phe);
(AC₅C)-V-Aib-EIQ-(α-Me-2,6-F-Phe)-Nle-HQ-(HoCit)-Aib-Cit-(α-Me-2,6-F-Phe);
Aib-V-Aib-EIQ-(α-Me-2F-Phe)-Nle-HQ-(HoCit)-A-Aib-(α-Me-2F-Phe);
Aib-V-Aib-EIQ-(α-Me-2F-Phe)-Nle-HQ-(HoCit)-Aib-Aib-(α-Me-2F-Phe);
(AC₅C)-V-Aib-EIQ-(α-Me-2F-Phe)-Nle-HQ-(HoCit)-A-Aib-(α-Me-2F-Phe);
(AC₅C)-V-Aib-EIQ-(α-Me-2F-Phe)-Nle-HQ-(HoCit)-Aib-Aib-(α-Me-2F-Phe);
Aib-V-Aib-EIQ-(α-Me-2,6-F-Phe)-Nle-HQ-(HoCit)-A-Aib-(α-Me-2F-Phe);
Aib-V-Aib-EIQ-(α-Me-2,6-F-Phe)-Nle-HQ-(HoCit)-Aib-Aib-(α-Me-2F-Phe);
(AC₅C)-V-Aib-EIQ-(α-Me-2,6-F-Phe)-Nle-HQ-(HoCit)-A-Aib-(α-Me-2F-Phe);
(AC₅C)-V-Aib-EIQ-(α-Me-2,6-F-Phe)-Nle-HQ-(HoCit)-Aib-Aib-(α-Me-2F-Phe);
Aib-V-Aib-EIQ-(α-Me-2F-Phe)-Nle-HQ-(HoCit)-A-Aib-(α-Me-2,6-F-Phe);
Aib-V-Aib-EIQ-(α-Me-2F-Phe)-Nle-HQ-(HoCit)-Aib-Aib-(α-Me-2,6-F-Phe);
(AC₅C)-V-Aib-EIQ-(α-Me-2F-Phe)-Nle-HQ-(HoCit)-A-Aib-(α-Me-2,6-F-Phe);
(AC₅C)-V-Aib-EIQ-(α-Me-2F-Phe)-Nle-HQ-(HoCit)-Aib-Aib-(α-Me-2,6-F-Phe);
Aib-V-Aib-EIQ-(α-Me-2,6-F-Phe)-Nle-HQ-(HoCit)-A-Aib-(α-Me-2,6-F-Phe);
Aib-V-Aib-EIQ-(α-Me-2,6-F-Phe)-Nle-HQ-(HoCit)-Aib-Aib-(α-Me-2,6-F-Phe);
(AC₅C)-V-Aib-EIQ-(α-Me-2,6-F-Phe)-Nle-HQ-(HoCit)-A-Aib-(α-Me-2,6-F-Phe);
(AC₅C)-V-Aib-EIQ-(α-Me-2,6-F-Phe)-Nle-HQ-(HoCit)-Aib-Aib-(α-Me-2,6-F-Phe);
Aib-V-Aib-EIQ-(α-Me-2F-Phe)-Nle-HQ-(HoCit)-A-(α-Me-2,6-F-Phe)-(α-Me-2F-Phe);
Aib-V-Aib-EIQ-(α-Me-2F-Phe)-Nle-HQ-(HoCit)-Aib-(α-Me-2,6-F-Phe)-(α-Me-2F-Phe);

(AC₅C)-V-Aib-EIQ-(α-Me-2F-Phe)-Nle-HQ-(HoCit)-A-(α-Me-2,6-F-Phe)-(α-Me-2F-Phe);
(AC₅C)-V-Aib-EIQ-(α-Me-2F-Phe)-Nle-HQ-(HoCit)-Aib-(α-Me-2,6-F-Phe)-(α-Me-2F-Phe);
Aib-V-Aib-EIQ-(α-Me-2,6-F-Phe)-Nle-HQ-(HoCit)-A-(α-Me-2,6-F-Phe)-(α-Me-2F-Phe);
Aib-V-Aib-EIQ-(α-Me-2,6-F-Phe)-Nle-HQ-(HoCit)-Aib-(α-Me-2,6-F-Phe)-(α-Me-2F-Phe);
(AC₅C)-V-Aib-EIQ-(α-Me-2,6-F-Phe)-Nle-HQ-(HoCit)-A-(α-Me-2,6-F-Phe)-(α-Me-2F-Phe);
(AC₅C)-V-Aib-EIQ-(α-Me-2,6-F-Phe)-Nle-HQ-(HoCit)-Aib-(α-Me-2,6-F-Phe)-(α-Me-2F-Phe);
Aib-V-Aib-EIQ-(α-Me-2F-Phe)-Nle-HQ-(HoCit)-A-(α-Me-2,6-F-Phe)-(α-Me-2,6-F-Phe);
Aib-V-Aib-EIQ-(α-Me-2F-Phe)-Nle-HQ-(HoCit)-Aib-(α-Me-2,6-F-Phe)-(α-Me-2,6-F-Phe);
(AC₅C)-V-Aib-EIQ-(α-Me-2F-Phe)-Nle-HQ-(HoCit)-A-(α-Me-2,6-F-Phe)-(α-Me-2,6-F-Phe);
(AC₅C)-V-Aib-EIQ-(α-Me-2F-Phe)-Nle-HQ-(HoCit)-Aib-(α-Me-2,6-F-Phe)-(α-Me-2,6-F-Phe);
Aib-V-Aib-EIQ-(α-Me-2,6-F-Phe)-Nle-HQ-(HoCit)-A-(α-Me-2,6-F-Phe)-(α-Me-2,6-F-Phe);
Aib-V-Aib-EIQ-(α-Me-2,6-F-Phe)-Nle-HQ-(HoCit)-Aib-(α-Me-2,6-F-Phe)-(α-Me-2,6-F-Phe);
(AC₅C)-V-Aib-EIQ-(α-Me-2,6-F-Phe)-Nle-HQ-(HoCit)-A-(α-Me-2,6-F-Phe)-(α-Me-2,6-F-Phe);
(AC₅C)-V-Aib-EIQ-(α-Me-2,6-F-Phe)-Nle-HQ-(HoCit)-Aib-(α-Me-2,6-F-Phe)-(α-Me-2,6-F-Phe);
Aib-V-Aib-EIQ-(α-Me-2F-Phe)-Nle-HQ-(HoCit)-A-Arg(NO₂)-(α-Me-2F-Phe);
Aib-V-Aib-EIQ-(α-Me-2F-Phe)-Nle-HQ-(HoCit)-Aib-Arg(NO₂)-(α-Me-2F-Phe);
(AC₅C)-V-Aib-EIQ-(α-Me-2F-Phe)-Nle-HQ-(HoCit)-A-Arg(NO₂)-(α-Me-2F-Phe);
(AC₅C)-V-Aib-EIQ-(α-Me-2F-Phe)-Nle-HQ-(HoCit)-Aib-Arg(NO₂)-(α-Me-2F-Phe);
Aib-V-Aib-EIQ-(α-Me-2,6-F-Phe)-Nle-HQ-(HoCit)-A-Arg(NO₂)-(α-Me-2F-Phe);
Aib-V-Aib-EIQ-(α-Me-2,6-F-Phe)-Nle-HQ-(HoCit)-Aib-Arg(NO₂)-(α-Me-2F-Phe);
(AC₅C)-V-Aib-EIQ-(α-Me-2,6-F-Phe)-Nle-HQ-(HoCit)-A-Arg(NO₂)-(α-Me-2F-Phe);
(AC₅C)-V-Aib-EIQ-(α-Me-2,6-F-Phe)-Nle-HQ-(HoCit)-Aib-Arg(NO₂)-(α-Me-2F-Phe);
Aib-V-Aib-EIQ-(α-Me-2F-Phe)-Nle-HQ-(HoCit)-A-Arg(NO₂)-(α-Me-2,6-F-Phe);
Aib-V-Aib-EIQ-(α-Me-2F-Phe)-Nle-HQ-(HoCit)-Aib-Arg(NO₂)-(α-Me-2,6-F-Phe);
(AC₅C)-V-Aib-EIQ-(α-Me-2F-Phe)-Nle-HQ-(HoCit)-A-Arg(NO₂)-(α-Me-2,6-F-Phe);
(AC₅C)-V-Aib-EIQ-(α-Me-2F-Phe)-Nle-HQ-(HoCit)-Aib-Arg(NO₂)-(α-Me-2,6-F-Phe);
Aib-V-Aib-EIQ-(α-Me-2,6-F-Phe)-Nle-HQ-(HoCit)-A-Arg(NO₂)-(α-Me-2,6-F-Phe);
Aib-V-Aib-EIQ-(α-Me-2,6-F-Phe)-Nle-HQ-(HoCit)-Aib-Arg(NO₂)-(α-Me-2,6-F-Phe);
(AC₅C)-V-Aib-EIQ-(α-Me-2,6-F-Phe)-Nle-HQ-(HoCit)-A-Arg(NO₂)-(α-Me-2,6-F-Phe);
(AC₅C)-V-Aib-EIQ-(α-Me-2,6-F-Phe)-Nle-HQ-(HoCit)-Aib-Arg(NO₂)-(α-Me-2,6-F-Phe);
Aib-V-Aib-EIQ-(α-Me-2F-Phe)-Nle-HQ-(α-Me-2,6-F-Phe)-A-Cit-(α-Me-2F-Phe);
Aib-V-Aib-EIQ-(α-Me-2F-Phe)-Nle-HQ-(α-Me-2,6-F-Phe)-Aib-Cit-(α-Me-2F-Phe);
(AC₅C)-V-Aib-EIQ-(α-Me-2F-Phe)-Nle-HQ-(α-Me-2,6-F-Phe)-A-Cit-(α-Me-2F-Phe);
(AC₅C)-V-Aib-EIQ-(α-Me-2F-Phe)-Nle-HQ-(α-Me-2,6-F-Phe)-Aib-Cit-(α-Me-2F-Phe);
Aib-V-Aib-EIQ-(α-Me-2,6-F-Phe)-Nle-HQ-(α-Me-2,6-F-Phe)-A-Cit-(α-Me-2F-Phe);
Aib-V-Aib-EIQ-(α-Me-2,6-F-Phe)-Nle-HQ-(α-Me-2,6-F-Phe)-Aib-Cit-(α-Me-2F-Phe);
(AC₅C)-V-Aib-EIQ-(α-Me-2,6-F-Phe)-Nle-HQ-(α-Me-2,6-F-Phe)-A-Cit-(α-Me-2F-Phe);
(AC₅C)-V-Aib-EIQ-(α-Me-2,6-F-Phe)-Nle-HQ-(α-Me-2,6-F-Phe)-Aib-Cit-(α-Me-2F-Phe);
Aib-V-Aib-EIQ-(α-Me-2F-Phe)-Nle-HQ-(α-Me-2,6-F-Phe)-A-Cit-(α-Me-2,6-F-Phe);
Aib-V-Aib-EIQ-(α-Me-2F-Phe)-Nle-HQ-(α-Me-2,6-F-Phe)-Aib-Cit-(α-Me-2,6-F-Phe);
(AC₅C)-V-Aib-EIQ-(α-Me-2F-Phe)-Nle-HQ-(α-Me-2,6-F-Phe)-A-Cit-(α-Me-2,6-F-Phe);
(AC₅C)-V-Aib-EIQ-(α-Me-2F-Phe)-Nle-HQ-(α-Me-2,6-F-Phe)-Aib-Cit-(α-Me-2,6-F-Phe);
Aib-V-Aib-EIQ-(α-Me-2,6-F-Phe)-Nle-HQ-(α-Me-2,6-F-Phe)-A-Cit-(α-Me-2,6-F-Phe);
Aib-V-Aib-EIQ-(α-Me-2,6-F-Phe)-Nle-HQ-(α-Me-2,6-F-Phe)-Aib-Cit-(α-Me-2,6-F-Phe);
(AC₅C)-V-Aib-EIQ-(α-Me-2,6-F-Phe)-Nle-HQ-(α-Me-2,6-F-Phe)-A-Cit-(α-Me-2,6-F-Phe);
(AC₅C)-V-Aib-EIQ-(α-Me-2,6-F-Phe)-Nle-HQ-(α-Me-2,6-F-Phe)-Aib-Cit-(α-Me-2,6-F-Phe);
Aib-V-Aib-EIQ-(α-Me-2F-Phe)-Nle-HQ-(α-Me-2,6-F-Phe)-A-Aib-(α-Me-2F-Phe);
Aib-V-Aib-EIQ-(α-Me-2F-Phe)-Nle-HQ-(α-Me-2,6-F-Phe)-Aib-Aib-(α-Me-2F-Phe);
(AC₅C)-V-Aib-EIQ-(α-Me-2F-Phe)-Nle-HQ-(α-Me-2,6-F-Phe)-A-Aib-(α-Me-2F-Phe);
(AC₅C)-V-Aib-EIQ-(α-Me-2F-Phe)-Nle-HQ-(α-Me-2,6-F-Phe)-Aib-Aib-(α-Me-2F-Phe);
Aib-V-Aib-EIQ-(α-Me-2,6-F-Phe)-Nle-HQ-(α-Me-2,6-F-Phe)-A-Aib-(α-Me-2F-Phe);
Aib-V-Aib-EIQ-(α-Me-2,6-F-Phe)-Nle-HQ-(α-Me-2,6-F-Phe)-Aib-Aib-(α-Me-2F-Phe);
(AC₅C)-V-Aib-EIQ-(α-Me-2,6-F-Phe)-Nle-HQ-(α-Me-2,6-F-Phe)-A-Aib-(α-Me-2F-Phe);
(AC₅C)-V-Aib-EIQ-(α-Me-2,6-F-Phe)-Nle-HQ-(α-Me-2,6-F-Phe)-Aib-Aib-(α-Me-2F-Phe);
Aib-V-Aib-EIQ-(α-Me-2F-Phe)-Nle-HQ-(α-Me-2,6-F-Phe)-A-Aib-(α-Me-2,6-F-Phe);
Aib-V-Aib-EIQ-(α-Me-2F-Phe)-Nle-HQ-(α-Me-2,6-F-Phe)-Aib-Aib-(α-Me-2,6-F-Phe);
(AC₅C)-V-Aib-EIQ-(α-Me-2F-Phe)-Nle-HQ-(α-Me-2,6-F-Phe)-A-Aib-(α-Me-2,6-F-Phe);
(AC₅C)-V-Aib-EIQ-(α-Me-2F-Phe)-Nle-HQ-(α-Me-2,6-F-Phe)-Aib-Aib-(α-Me-2,6-F-Phe);
Aib-V-Aib-EIQ-(α-Me-2,6-F-Phe)-Nle-HQ-(α-Me-2,6-F-Phe)-A-Aib-(α-Me-2,6-F-Phe);
Aib-V-Aib-EIQ-(α-Me-2,6-F-Phe)-Nle-HQ-(α-Me-2,6-F-Phe)-Aib-Aib-(α-Me-2,6-F-Phe);
(AC₅C)-V-Aib-EIQ-(α-Me-2,6-F-Phe)-Nle-HQ-(α-Me-2,6-F-Phe)-A-Aib-(α-Me-2,6-F-Phe);
(AC₅C)-V-Aib-EIQ-(α-Me-2,6-F-Phe)-Nle-HQ-(α-Me-2,6-F-Phe)-Aib-Aib-(α-Me-2,6-F-Phe);
Aib-V-Aib-EIQ-(α-Me-2F-Phe)-Nle-HQ-(α-Me-2,6-F-Phe)-A-(α-Me-2,6-F-Phe)-(α-Me-2F-Phe);
Aib-V-Aib-EIQ-(α-Me-2F-Phe)-Nle-HQ-(α-Me-2,6-F-Phe)-Aib-(α-Me-2,6-F-Phe)-(α-Me-2F-Phe);
(AC₅C)-V-Aib-EIQ-(α-Me-2F-Phe)-Nle-HQ-(α-Me-2,6-F-Phe)-A-(α-Me-2,6-F-Phe)-(α-Me-2F-Phe);
(AC₅C)-V-Aib-EIQ-(α-Me-2F-Phe)-Nle-HQ-(α-Me-2,6-F-Phe)-Aib-(α-Me-2,6-F-Phe)-(α-Me-2F-Phe);

Aib-V-Aib-EIQ-(α-Me-2,6-F-Phe)-Nle-HQ-(α-Me-2,6-F-Phe)-A-(α-Me-2,6-F-Phe)-(α-Me-2F-Phe);
Aib-V-Aib-EIQ-(α-Me-2,6-F-Phe)-Nle-HQ-(α-Me-2,6-F-Phe)-Aib-(α-Me-2,6-F-Phe)-(α-Me-2F-Phe);
(AC$_5$C)-V-Aib-EIQ-(α-Me-2,6-F-Phe)-Nle-HQ-(α-Me-2,6-F-Phe)-A-(α-Me-2,6-F-Phe)-(α-Me-2F-Phe);
(AC$_5$C)-V-Aib-EIQ-(α-Me-2,6-F-Phe)-Nle-HQ-(α-Me-2,6-F-Phe)-Aib-(α-Me-2,6-F-Phe)-(α-Me-2F-Phe);
Aib-V-Aib-EIQ-(α-Me-2F-Phe)-Nle-HQ-(α-Me-2,6-F-Phe)-A-(α-Me-2,6-F-Phe)-(α-Me-2,6-F-Phe);
Aib-V-Aib-EIQ-(α-Me-2F-Phe)-Nle-HQ-(α-Me-2,6-F-Phe)-Aib-(α-Me-2,6-F-Phe)-(α-Me-2,6-F-Phe);
(AC$_5$C)-V-Aib-EIQ-(α-Me-2F-Phe)-Nle-HQ-(α-Me-2,6-F-Phe)-A-(α-Me-2,6-F-Phe)-(α-Me-2,6-F-Phe);
(AC$_5$C)-V-Aib-EIQ-(α-Me-2F-Phe)-Nle-HQ-(α-Me-2,6-F-Phe)-Aib-(α-Me-2,6-F-Phe)-(α-Me-2,6-F-Phe);
Aib-V-Aib-EIQ-(α-Me-2,6-F-Phe)-Nle-HQ-(α-Me-2,6-F-Phe)-A-(α-Me-2,6-F-Phe)-(α-Me-2,6-F-Phe);
Aib-V-Aib-EIQ-(α-Me-2,6-F-Phe)-Nle-HQ-(α-Me-2,6-F-Phe)-Aib-(α-Me-2,6-F-Phe)-(α-Me-2,6-F-Phe);
(AC$_5$C)-V-Aib-EIQ-(α-Me-2,6-F-Phe)-Nle-HQ-(α-Me-2,6-F-Phe)-A-(α-Me-2,6-F-Phe)-(α-Me-2,6-F-Phe);
(AC$_5$C)-V-Aib-EIQ-(α-Me-2,6-F-Phe)-Nle-HQ-(α-Me-2,6-F-Phe)-Aib-(α-Me-2,6-F-Phe)-(α-Me-2,6-F-Phe);
Aib-V-Aib-EIQ-(α-Me-2F-Phe)-Nle-HQ-(α-Me-2,6-F-Phe)-A-Arg(NO$_2$)-(α-Me-2F-Phe);
Aib-V-Aib-EIQ-(α-Me-2F-Phe)-Nle-HQ-(α-Me-2,6-F-Phe)-Aib-Arg(NO$_2$)-(α-Me-2F-Phe);
(AC$_5$C)-V-Aib-EIQ-(α-Me-2F-Phe)-Nle-HQ-(α-Me-2,6-F-Phe)-A-Arg(NO$_2$)-(α-Me-2F-Phe);
(AC$_5$C)-V-Aib-EIQ-(α-Me-2F-Phe)-Nle-HQ-(α-Me-2,6-F-Phe)-Aib-Arg(NO$_2$)-(α-Me-2F-Phe);
Aib-V-Aib-EIQ-(α-Me-2,6-F-Phe)-Nle-HQ-(α-Me-2,6-F-Phe)-A-Arg(NO$_2$)-(α-Me-2F-Phe);
Aib-V-Aib-EIQ-(α-Me-2,6-F-Phe)-Nle-HQ-(α-Me-2,6-F-Phe)-Aib-Arg(NO$_2$)-(α-Me-2F-Phe);
(AC$_5$C)-V-Aib-EIQ-(α-Me-2,6-F-Phe)-Nle-HQ-(α-Me-2,6-F-Phe)-A-Arg(NO$_2$)-(α-Me-2F-Phe);
(AC$_5$C)-V-Aib-EIQ-(α-Me-2,6-F-Phe)-Nle-HQ-(α-Me-2,6-F-Phe)-Aib-Arg(NO$_2$)-(α-Me-2F-Phe);
Aib-V-Aib-EIQ-(α-Me-2F-Phe)-Nle-HQ-(α-Me-2,6-F-Phe)-A-Arg(NO$_2$)-(α-Me-2,6-F-Phe);
Aib-V-Aib-EIQ-(α-Me-2F-Phe)-Nle-HQ-(α-Me-2,6-F-Phe)-Aib-Arg(NO$_2$)-(α-Me-2,6-F-Phe);
(AC$_5$C)-V-Aib-EIQ-(α-Me-2F-Phe)-Nle-HQ-(α-Me-2,6-F-Phe)-A-Arg(NO$_2$)-(α-Me-2,6-F-Phe);
(AC$_5$C)-V-Aib-EIQ-(α-Me-2F-Phe)-Nle-HQ-(α-Me-2,6-F-Phe)-Aib-Arg(NO$_2$)-(α-Me-2,6-F-Phe);
Aib-V-Aib-EIQ-(α-Me-2,6-F-Phe)-Nle-HQ-(α-Me-2,6-F-Phe)-A-Arg(NO$_2$)-(α-Me-2,6-F-Phe);
Aib-V-Aib-EIQ-(α-Me-2,6-F-Phe)-Nle-HQ-(α-Me-2,6-F-Phe)-Aib-Arg(NO$_2$)-(α-Me-2,6-F-Phe);
(AC$_5$C)-V-Aib-EIQ-(α-Me-2,6-F-Phe)-Nle-HQ-(α-Me-2,6-F-Phe)-A-Arg(NO$_2$)-(α-Me-2,6-F-Phe);
(AC$_5$C)-V-Aib-EIQ-(α-Me-2,6-F-Phe)-Nle-HQ-(α-Me-2,6-F-Phe)-Aib-Arg(NO$_2$)-(α-Me-2,6-F-Phe);
Aib-V-Aib-EIQ-(α-Me-2F-Phe)-Nle-HQ-Aib-A-Cit-(α-Me-2F-Phe);
Aib-V-Aib-EIQ-(α-Me-2F-Phe)-Nle-HQ-Aib-Aib-Cit-(α-Me-2F-Phe);
(AC$_5$C)-V-Aib-EIQ-(α-Me-2F-Phe)-Nle-HQ-Aib-A-Cit-(α-Me-2F-Phe);
(AC$_5$C)-V-Aib-EIQ-(α-Me-2F-Phe)-Nle-HQ-Aib-Aib-Cit-(α-Me-2F-Phe);
Aib-V-Aib-EIQ-(α-Me-2,6-F-Phe)-Nle-HQ-Aib-A-Cit-(α-Me-2F-Phe);
Aib-V-Aib-EIQ-(α-Me-2,6-F-Phe)-Nle-HQ-Aib-Aib-Cit-(α-Me-2F-Phe);
(AC$_5$C)-V-Aib-EIQ-(α-Me-2,6-F-Phe)-Nle-HQ-Aib-A-Cit-(α-Me-2F-Phe);
(AC$_5$C)-V-Aib-EIQ-(α-Me-2,6-F-Phe)-Nle-HQ-Aib-Aib-Cit-(α-Me-2F-Phe);
Aib-V-Aib-EIQ-(α-Me-2F-Phe)-Nle-HQ-Aib-A-Cit-(α-Me-2,6-F-Phe);
Aib-V-Aib-EIQ-(α-Me-2F-Phe)-Nle-HQ-Aib-Aib-Cit-(α-Me-2,6-F-Phe);
(AC$_5$C)-V-Aib-EIQ-(α-Me-2F-Phe)-Nle-HQ-Aib-A-Cit-(α-Me-2,6-F-Phe);
(AC$_5$C)-V-Aib-EIQ-(α-Me-2F-Phe)-Nle-HQ-Aib-Aib-Cit-(α-Me-2,6-F-Phe);
Aib-V-Aib-EIQ-(α-Me-2,6-F-Phe)-Nle-HQ-Aib-A-Cit-(α-Me-2,6-F-Phe);
Aib-V-Aib-EIQ-(α-Me-2,6-F-Phe)-Nle-HQ-Aib-Aib-Cit-(α-Me-2,6-F-Phe);
(AC$_5$C)-V-Aib-EIQ-(α-Me-2,6-F-Phe)-Nle-HQ-Aib-A-Cit-(α-Me-2,6-F-Phe);
(AC$_5$C)-V-Aib-EIQ-(α-Me-2,6-F-Phe)-Nle-HQ-Aib-Aib-Cit-(α-Me-2,6-F-Phe);
Aib-V-Aib-EIQ-(α-Me-2F-Phe)-Nle-HQ-Aib-A-Aib-(α-Me-2F-Phe);
Aib-V-Aib-EIQ-(α-Me-2F-Phe)-Nle-HQ-Aib-Aib-Aib-(α-Me-2F-Phe);
(AC$_5$C)-V-Aib-EIQ-(α-Me-2F-Phe)-Nle-HQ-Aib-A-Aib-(α-Me-2F-Phe);
(AC$_5$C)-V-Aib-EIQ-(α-Me-2F-Phe)-Nle-HQ-Aib-Aib-Aib-(α-Me-2F-Phe);
Aib-V-Aib-EIQ-(α-Me-2,6-F-Phe)-Nle-HQ-Aib-A-Aib-(α-Me-2F-Phe);
Aib-V-Aib-EIQ-(α-Me-2,6-F-Phe)-Nle-HQ-Aib-Aib-Aib-(α-Me-2F-Phe);
(AC$_5$C)-V-Aib-EIQ-(α-Me-2,6-F-Phe)-Nle-HQ-Aib-A-Aib-(α-Me-2F-Phe);
(AC$_5$C)-V-Aib-EIQ-(α-Me-2,6-F-Phe)-Nle-HQ-Aib-Aib-Aib-(α-Me-2F-Phe);
Aib-V-Aib-EIQ-(α-Me-2F-Phe)-Nle-HQ-Aib-A-Aib-(α-Me-2,6-F-Phe);
Aib-V-Aib-EIQ-(α-Me-2F-Phe)-Nle-HQ-Aib-Aib-Aib-(α-Me-2,6-F-Phe);
(AC$_5$C)-V-Aib-EIQ-(α-Me-2F-Phe)-Nle-HQ-Aib-A-Aib-(α-Me-2,6-F-Phe);
(AC$_5$C)-V-Aib-EIQ-(α-Me-2F-Phe)-Nle-HQ-Aib-Aib-Aib-(α-Me-2,6-F-Phe);
Aib-V-Aib-EIQ-(α-Me-2,6-F-Phe)-Nle-HQ-Aib-A-Aib-(α-Me-2,6-F-Phe);
Aib-V-Aib-EIQ-(α-Me-2,6-F-Phe)-Nle-HQ-Aib-Aib-Aib-(α-Me-2,6-F-Phe);
(AC$_5$C)-V-Aib-EIQ-(α-Me-2,6-F-Phe)-Nle-HQ-Aib-A-Aib-(α-Me-2,6-F-Phe);
(AC$_5$C)-V-Aib-EIQ-(α-Me-2,6-F-Phe)-Nle-HQ-Aib-Aib-Aib-(α-Me-2,6-F-Phe);
Aib-V-Aib-EIQ-(α-Me-2F-Phe)-Nle-HQ-Aib-A-(α-Me-2,6-F-Phe)-(α-Me-2F-Phe);
Aib-V-Aib-EIQ-(α-Me-2F-Phe)-Nle-HQ-Aib-Aib-(α-Me-2,6-F-Phe)-(α-Me-2F-Phe);
(AC$_5$C)-V-Aib-EIQ-(α-Me-2F-Phe)-Nle-HQ-Aib-A-(α-Me-2,6-F-Phe)-(α-Me-2F-Phe);
(AC$_5$C)-V-Aib-EIQ-(α-Me-2F-Phe)-Nle-HQ-Aib-Aib-(α-Me-2,6-F-Phe)-(α-Me-2F-Phe);
Aib-V-Aib-EIQ-(α-Me-2,6-F-Phe)-Nle-HQ-Aib-A-(α-Me-2,6-F-Phe)-(α-Me-2F-Phe);
Aib-V-Aib-EIQ-(α-Me-2,6-F-Phe)-Nle-HQ-Aib-Aib-(α-Me-2,6-F-Phe)-(α-Me-2F-Phe);

(AC₅C)-V-Aib-EIQ-(α-Me-2,6-F-Phe)-Nle-HQ-Aib-A-(α-Me-2,6-F-Phe)-(α-Me-2F-Phe);
(AC₅C)-V-Aib-EIQ-(α-Me-2,6-F-Phe)-Nle-HQ-Aib-Aib-(α-Me-2,6-F-Phe)-(α-Me-2F-Phe);
Aib-V-Aib-EIQ-(α-Me-2F-Phe)-Nle-HQ-Aib-A-(α-Me-2,6-F-Phe)-(α-Me-2,6-F-Phe);
Aib-V-Aib-EIQ-(α-Me-2F-Phe)-Nle-HQ-Aib-Aib-(α-Me-2,6-F-Phe)-(α-Me-2,6-F-Phe);
(AC₅C)-V-Aib-EIQ-(α-Me-2F-Phe)-Nle-HQ-Aib-A-(α-Me-2,6-F-Phe)-(α-Me-2,6-F-Phe);
(AC₅C)-V-Aib-EIQ-(α-Me-2F-Phe)-Nle-HQ-Aib-Aib-(α-Me-2,6-F-Phe)-(α-Me-2,6-F-Phe);
Aib-V-Aib-EIQ-(α-Me-2,6-F-Phe)-Nle-HQ-Aib-A-(α-Me-2,6-F-Phe)-(α-Me-2,6-F-Phe);
Aib-V-Aib-EIQ-(α-Me-2,6-F-Phe)-Nle-HQ-Aib-Aib-(α-Me-2,6-F-Phe)-(α-Me-2,6-F-Phe);
(AC₅C)-V-Aib-EIQ-(α-Me-2,6-F-Phe)-Nle-HQ-Aib-A-(α-Me-2,6-F-Phe)-(α-Me-2,6-F-Phe);  (AC₅C)-V-Aib-EIQ-(α-Me-2,6-F-Phe)-Nle-HQ-Aib-Aib-(α-Me-2,6-F-Phe)-(α-Me-2,6-F-Phe);
Aib-V-Aib-EIQ-(α-Me-2F-Phe)-Nle-HQ-Aib-A-Arg(NO₂)-(α-Me-2F-Phe);
Aib-V-Aib-EIQ-(α-Me-2F-Phe)-Nle-HQ-Aib-Aib-Arg(NO₂)-(α-Me-2F-Phe);
(AC₅C)-V-Aib-EIQ-(α-Me-2F-Phe)-Nle-HQ-Aib-A-Arg(NO₂)-(α-Me-2F-Phe);
(AC₅C)-V-Aib-EIQ-(α-Me-2F-Phe)-Nle-HQ-Aib-Aib-Arg(NO₂)-(α-Me-2F-Phe);
Aib-V-Aib-EIQ-(α-Me-2,6-F-Phe)-Nle-HQ-Aib-A-Arg(NO₂)-(α-Me-2F-Phe);
Aib-V-Aib-EIQ-(α-Me-2,6-F-Phe)-Nle-HQ-Aib-Aib-Arg(NO₂)-(α-Me-2F-Phe);
(AC₅C)-V-Aib-EIQ-(α-Me-2,6-F-Phe)-Nle-HQ-Aib-A-Arg(NO₂)-(α-Me-2F-Phe);
(AC₅C)-V-Aib-EIQ-(α-Me-2,6-F-Phe)-Nle-HQ-Aib-Aib-Arg(NO₂)-(α-Me-2F-Phe);
Aib-V-Aib-EIQ-(α-Me-2F-Phe)-Nle-HQ-Aib-A-Arg(NO₂)-(α-Me-2,6-F-Phe);
Aib-V-Aib-EIQ-(α-Me-2F-Phe)-Nle-HQ-Aib-Aib-Arg(NO₂)-(α-Me-2,6-F-Phe);  (AC₅C)-V-Aib-EIQ-(α-Me-2F-Phe)-Nle-HQ-Aib-A-Arg(NO₂)-(α-Me-2,6-F-Phe);
(AC₅C)-V-Aib-EIQ-(α-Me-2F-Phe)-Nle-HQ-Aib-Aib-Arg(NO₂)-(α-Me-2,6-F-Phe);
Aib-V-Aib-EIQ-(α-Me-2,6-F-Phe)-Nle-HQ-Aib-A-Arg(NO₂)-(α-Me-2,6-F-Phe);
Aib-V-Aib-EIQ-(α-Me-2,6-F-Phe)-Nle-HQ-Aib-Aib-Arg(NO₂)-(α-Me-2,6-F-Phe);
(AC₅C)-V-Aib-EIQ-(α-Me-2,6-F-Phe)-Nle-HQ-Aib-A-Arg(NO₂)-(α-Me-2,6-F-Phe);
(AC₅C)-V-Aib-EIQ-(α-Me-2,6-F-Phe)-Nle-HQ-Aib-Aib-Arg(NO₂)-(α-Me-2,6-F-Phe);
Aib-V-Aib-EIQLMHQ-Har-AK-(Bip(OMe))-(APPA);
Aib-V-Aib-EIQL-Nle-HQ-Har-AK-(Bip(OMe))-(APPA);
(AC₃C)-V-Aib-EIQLMHQ-Har-AK-(Bip(OMe))-(APPA);
(AC₃C)-V-Aib-EIQL-Nle-HQ-Har-AK-(Bip(OMe))-(APPA);
(AC₅C)-V-Aib-EIQLMHQ-Har-AK-(Bip(OMe))-(APPA);
(AC₅C)-V-Aib-EIQL-Nle-HQ-Har-AK-(Bip(OMe))-(APPA);
Aib-V-(AC₃C)-EIQLMHQ-Har-AK-(Bip(OMe))-(APPA);
Aib-V-(AC₃C)-EIQL-Nle-HQ-Har-AK-(Bip(OMe))-(APPA);
(AC₃C)-V-(AC₃C)-EIQLMHQ-Har-AK-(Bip(OMe))-(APPA);
(AC₃C)-V-(AC₃C)-EIQL-Nle-HQ-Har-AK-(Bip(OMe))-(APPA);
(AC₅C)-V-(AC₃C)-EIQLMHQ-Har-AK-(Bip(OMe))-(APPA);
(AC₅C)-V-(AC₃C)-EIQL-Nle-HQ-Har-AK-(Bip(OMe))-(APPA);
Aib-V-Aib-EIQLMHQ-Har(NO₂)-AK-(Bip(OMe))-(APPA);
Aib-V-Aib-EIQL-Nle-HQ-Har(NO₂)-AK-(Bip(OMe))-(APPA);
(AC₃C)-V-Aib-EIQLMHQ-Har(NO₂)-AK-(Bip(OMe))-(APPA);
(AC₃C)-V-Aib-EIQL-Nle-HQ-Har(NO₂)-AK-(Bip(OMe))-(APPA);
(AC₅C)-V-Aib-EIQLMHQ-Har(NO₂)-AK-(Bip(OMe))-(APPA);
(AC₅C)-V-Aib-EIQL-Nle-HQ-Har(NO₂)-AK-(Bip(OMe))-(APPA);
Aib-V-(AC₃C)-EIQLMHQ-Har(NO₂)-AK-(Bip(OMe))-(APPA);
Aib-V-(AC₃C)-EIQL-Nle-HQ-Har(NO₂)-AK-(Bip(OMe))-(APPA);
(AC₃C)-V-(AC₃C)-EIQLMHQ-Har(NO₂)-AK-(Bip(OMe))-(APPA);
(AC₃C)-V-(AC₃C)-EIQL-Nle-HQ-Har(NO₂)-AK-(Bip(OMe))-(APPA);
(AC₅C)-V-(AC₃C)-EIQLMHQ-Har(NO₂)-AK-(Bip(OMe))-(APPA);
(AC₅C)-V-(AC₃C)-EIQL-Nle-HQ-Har(NO₂)-AK-(Bip(OMe))-(APPA);
Aib-V-Aib-EIQLMHQ-Har(NO₂)-A-K(Biotin)-(Bip(OMe))-(APPA);
Aib-V-Aib-EIQL-Nle-HQ-Har(NO₂)-A-K(Biotin)-(Bip(OMe))-(APPA);
Aib-V-Aib-EIQLMHQ-Har-A-K(Biotin)-(Bip(OMe))-(APPA);
Aib-V-Aib-EIQL-Nle-HQ-Har-A-K(Biotin)-(Bip(OMe))-(APPA);
Aib-V-Aib-EIQLMHQ-Har(NO₂)-A-K(—CO—(CH₂)₆—CH₃)-(Bip(OMe))-(APPA);
Aib-V-Aib-EIQL-Nle-HQ-Har(NO₂)-A-K(—CO—(CH₂)₆—CH₃)-(Bip(OMe))-(APPA);
Aib-V-Aib-EIQLMHQ-Har-A-K(—CO—(CH₂)₆—CH₃)-(Bip(OMe))-(APPA);
Aib-V-Aib-EIQL-Nle-HQ-Har-A-K(—CO—(CH₂)₆—CH₃)-(Bip(OMe))-(APPA);
Aib-V-Aib-EIQLMHQ-Har(NO₂)-A-K(—CO—(CH₂)₈—CH₃)-(Bip(OMe))-(APPA);
Aib-V-Aib-EIQL-Nle-HQ-Har(NO₂)-A-K(—CO—(CH₂)₈—CH₃)-(Bip(OMe))-(APPA);
Aib-V-Aib-EIQLMHQ-Har-A-K(—CO—(CH₂)₈—CH₃)-(Bip(OMe))-(APPA);
Aib-V-Aib-EIQL-Nle-HQ-Har-A-K(—CO—(CH₂)₈—CH₃)-(Bip(OMe))-(APPA);
(AC₅C)-V-(AC₃C)-EIQL-Nle-HQ-Har-A-K(—CO—(CH₂)₈—CH₃)-(Bip(OMe))-(APPA);
(AC₅C)-V-(AC₃C)-EIQLMHQ-Har(NO₂)-A-(NMe)K-(Bip(OMe))-(APPA);
(AC₅C)-V-(AC₃C)-EIQL-Nle-HQ-Har(NO₂)-A-(NMe)K-(Bip(OMe))-(APPA);
(AC₅C)-V-(AC₃C)-EIQL-(NMe)M-HQ-Har-A-K(—CO—(CH₂)₈—CH₃)-(Bip(OMe))-(APPA);
(AC₅C)-V-(AC₃C)-EIQL-(NMe)Nle-HQ-Har-A-K(—CO—(CH₂)₈—CH₃)-(Bip(OMe))-(APPA);
(AC₃C)-V-(AC₃C)-EIQL-(NMe)M-HQ-Har(NO₂)-A-(NMe)K-(Bip(OMe))-(APPA);

($AC_3C$)-V-($AC_3C$)-EIQL-(NMe)Nle-HQ-Har($NO_2$)-A-(NMe)K-(Bip(OMe))-(APPA);
($AC_5C$)-V-($AC_3C$)-EIQL-(NMe)M-HQ-Har($NO_2$)-A-(NMe)K-(Bip(OMe))-(APPA);
($AC_5C$)-V-($AC_3C$)-EIQL-(NMe)Nle-HQ-Har($NO_2$)-A-(NMe)K-(Bip(OMe))-(APPA);
Aib-V-Aib-EIQLMHQ-Har-AK-(Bip(OMe));
Aib-V-Aib-EIQL-Nle-HQ-Har-AK-(Bip(OMe));
($AC_3C$)-V-Aib-EIQLMHQ-Har-AK-(Bip(OMe));
($AC_3C$)-V-Aib-EIQL-Nle-HQ-Har-AK-(Bip(OMe));
($AC_5C$)-V-Aib-EIQLMHQ-Har-AK-(Bip(OMe));
($AC_5C$)-V-Aib-EIQL-Nle-HQ-Har-AK-(Bip(OMe));
Aib-V-($AC_3C$)-EIQLMHQ-Har-AK-(Bip(OMe));
Aib-V-($AC_3C$)-EIQL-Nle-HQ-Har-AK-(Bip(OMe));
($AC_3C$)-V-($AC_3C$)-EIQLMHQ-Har-AK-(Bip(OMe));
($AC_3C$)-V-($AC_3C$)-EIQL-Nle-HQ-Har-AK-(Bip(OMe));
($AC_5C$)-V-($AC_3C$)-EIQLMHQ-Har-AK-(Bip(OMe));
($AC_5C$)-V-($AC_3C$)-EIQL-Nle-HQ-Har-AK-(Bip(OMe));
Aib-V-Aib-EIQLMHQ-Har($NO_2$)-AK-(Bip(OMe));
Aib-V-Aib-EIQL-Nle-HQ-Har($NO_2$)-AK-(Bip(OMe));
Aib-V-Aib-EIQLMHQ-Har($NO_2$)-A-K(Biotin)-(Bip(OMe));
Aib-V-Aib-EIQL-Nle-HQ-Har($NO_2$)-A-K(Biotin)-(Bip(OMe));
Aib-V-Aib-EIQLMHQ-Har-A-K(Biotin)-(Bip(OMe));
Aib-V-Aib-EIQL-Nle-HQ-Har-A-K(Biotin)-(Bip(OMe));
Aib-V-Aib-EIQLMHQ-Har($NO_2$)-A-K(—CO—($CH_2$)$_6$—$CH_3$)-(Bip(OMe));
Aib-V-Aib-EIQL-Nle-HQ-Har($NO_2$)-A-K(—CO—($CH_2$)$_6$—$CH_3$)-(Bip(OMe));
Aib-V-Aib-EIQLMHQ-Har-A-K(—CO—($CH_2$)$_6$—$CH_3$)-(Bip(OMe));
Aib-V-Aib-EIQL-Nle-HQ-Har-A-K(—CO—($CH_2$)$_6$—$CH_3$)-(Bip(OMe));
Aib-V-Aib-EIQLMHQ-Har($NO_2$)-A-K(—CO—($CH_2$)$_8$—$CH_3$)-(Bip(OMe));
Aib-V-Aib-EIQL-Nle-HQ-Har($NO_2$)-A-K(—CO—($CH_2$)$_8$—$CH_3$)-(Bip(OME);
Aib-V-Aib-EIQLMHQ-Har-A-K(—CO—($CH_2$)$_8$—$CH_3$)-(Bip(OMe));
Aib-V-Aib-EIQL-Nle-HQ-Har-A-K(—CO—($CH_2$)$_8$—$CH_3$)-(Bip(OMe));
($AC_5C$)-V-($AC_3C$)-EIQLMHQ-Har-A-K(—CO—($CH_2$)$_8$—$CH_3$)-(Bip(OMe));
($AC_5C$)-V-($AC_3C$)-EIQL-Nle-HQ-Har-A-K(—CO—($CH_2$)$_8$—$CH_3$)-(Bip(OMe));
($AC_5C$)-V-($AC_3C$)-EIQLMHQ-Har($NO_2$)-A-(NMe)K-(Bip(OMe));
($AC_5C$)-V-($AC_3C$)-EIQL-Nle-HQ-Har($NO_2$)-A-(NMe)K-(Bip(OMe));
Aib-V-Aib-EIQL-(NMe)M-HQ-Har-A-K(—CO—($CH_2$)$_8$—$CH_3$)-(Bip(OMe));
Aib-V-Aib-EIQL-(NMe)Nle-HQ-Har-A-K(—CO—($CH_2$)$_8$—$CH_3$)-(Bip(OMe));
($AC_3C$)-V-Aib-EIQL-(NMe)M-HQ-Har-A-K(—CO—($CH_2$)$_8$—$CH_3$)-(Bip(OMe));
($AC_3C$)-V-Aib-EIQL-(NMe)Nle-HQ-Har-A-K(—CO—($CH_2$)$_8$—$CH_3$)-(Bip(OMe));
Aib-V-Aib-EIQLMHQ-Har-A-Arg($NO_2$)-(Bip(OMe))-(APPA);
Aib-V-Aib-EIQL-Nle-HQ-Har-A-Arg($NO_2$)-(Bip(OMe))-(APPA);
($AC_3C$)-V-Aib-EIQLMHQ-Har-A-Arg($NO_2$)-(Bip(OMe))-(APPA);
($AC_3C$)-V-Aib-EIQL-Nle-HQ-Har-A-Arg($NO_2$)-(Bip(OMe))-(APPA);
($AC_5C$)-V-Aib-EIQLMHQ-Har-A-Arg($NO_2$)-(Bip(OMe))-(APPA);
($AC_5C$)-V-Aib-EIQLMHQ-Har-Aib-Arg($NO_2$)-(Bip(OMe))-(APPA);
($AC_5C$)-V-Aib-EIQL-Nle-HQ-Har-A-Arg($NO_2$)-(Bip(OMe))-(APPA);
Aib-V-($AC_3C$)-EIQLMHQ-Har-A-Arg($NO_2$)-(Bip(OMe))-(APPA);
Aib-V-($AC_3C$)-EIQL-Nle-HQ-Har-A-Arg($NO_2$)-(Bip(OMe))-(APPA);
($AC_3C$)-V-($AC_3C$)-EIQLMHQ-Har-A-Arg($NO_2$)-(Bip(OMe))-(APPA);
($AC_3C$)-V-($AC_3C$)-EIQL-Nle-HQ-Har-A-Arg($NO_2$)-(Bip(OMe))-(APPA);
($AC_5C$)-V-($AC_3C$)-EIQLMHQ-Har-A-Arg($NO_2$)-(Bip(OMe))-(APPA);
($AC_5C$)-V-($AC_3C$)-EIQL-Nle-HQ-Har-A-Arg($NO_2$)-(Bip(OMe))-(APPA);
Aib-V-Aib-EIQ-(α-Me-2,6-F-Phe)-Nle-HQ-Har-A-Arg($NO_2$)-(Bip(OMe))-(APPA);
($AC_3C$)-V-Aib-EIQ-(α-Me-2,6-F-Phe)-Nle-HQ-Har-A-Arg($NO_2$)-(Bip(OMe))-(APPA);
($AC_5C$)-V-Aib-EIQ-(α-Me-2,6-F-Phe)-Nle-HQ-Har-A-Arg($NO_2$)-(Bip(OMe))-(APPA);
Aib-V-($AC_3C$)-EIQ-(α-Me-2,6-F-Phe)-Nle-HQ-Har-A-Arg($NO_2$)-(Bip(OMe))-(APPA);
($AC_3C$)-V-($AC_3C$)-EIQ-(α-Me-2,6-F-Phe)-Nle-HQ-Har-A-Arg($NO_2$)-(Bip(OMe))-(APPA);
($AC_5C$)-V-($AC_3C$)-EIQ-(α-Me-2,6-F-Phe)-Nle-HQ-Har-A-Arg($NO_2$)-(Bip(OMe))-(APPA);
Aib-V-Aib-EIQ-(α-Me-2F-Phe)-Nle-HQ-Har-A-Arg($NO_2$)-(Bip(OMe))-(APPA);
($AC_3C$)-V-Aib-EIQ-(α-Me-2F-Phe)-Nle-HQ-Har-A-Arg($NO_2$)-(Bip(OMe))-(APPA);
($AC_5C$)-V-Aib-EIQ-(α-Me-2F-Phe)-Nle-HQ-Har-A-Arg($NO_2$)-(Bip(OMe))-(APPA);
Aib-V-($AC_3C$)-EIQ-(α-Me-2F-Phe)-Nle-HQ-Har-A-Arg($NO_2$)-(Bip(OMe))-(APPA);
($AC_3C$)-V-($AC_3C$)-EIQ-(α-Me-2F-Phe)-Nle-HQ-Har-A-Arg($NO_2$)-(Bip(OMe))-(APPA);
($AC_5C$)-V-($AC_3C$)-EIQ-(α-Me-2F-Phe)-Nle-HQ-Har-A-Arg($NO_2$)-(Bip(OMe))-(APPA);
Aib-V-Aib-EIQ-(α-Me-2,6-F-Phe)-Nle-HQ-Har-A-Arg($NO_2$)-(α-Me-2,6-F-Phe)-(APPA);
($AC_3C$)-V-Aib-EIQ-(α-Me-2,6-F-Phe)-Nle-HQ-Har-A-Arg($NO_2$)-(α-Me-2,6-F-Phe)-(APPA);
($AC_5C$)-V-Aib-EIQ-(α-Me-2,6-F-Phe)-Nle-HQ-Har-A-Arg($NO_2$)-(α-Me-2,6-F-Phe)-(APPA);
Aib-V-($AC_3C$)-EIQ-(α-Me-2,6-F-Phe)-Nle-HQ-Har-A-Arg($NO_2$)-(α-Me-2,6-F-Phe)-(APPA);
($AC_3C$)-V-($AC_3C$)-EIQ-(α-Me-2,6-F-Phe)-Nle-HQ-Har-A-Arg($NO_2$)-(α-Me-2,6-F-Phe)-(APPA);
($AC_5C$)-V-($AC_3C$)-EIQ-(α-Me-2,6-F-Phe)-Nle-HQ-Har-A-Arg($NO_2$)-(α-Me-2,6-F-Phe)-(APPA);
Aib-V-Aib-EIQ-(α-Me-2F-Phe)-Nle-HQ-Har-A-Arg($NO_2$)-(α-Me-2,6-F-Phe)-(APPA);
($AC_3C$)-V-Aib-EIQ-(α-Me-2F-Phe)-Nle-HQ-Har-A-Arg($NO_2$)-(α-Me-2,6-F-Phe)-(APPA);
($AC_5C$)-V-Aib-EIQ-(α-Me-2F-Phe)-Nle-HQ-Har-A-Arg($NO_2$)-(α-Me-2,6-F-Phe)-(APPA);
Aib-V-($AC_3C$)-EIQ-(α-Me-2F-Phe)-Nle-HQ-Har-A-Arg($NO_2$)-(α-Me-2,6-F-Phe)-(APPA);
($AC_3C$)-V-($AC_3C$)-EIQ-(α-Me-2F-Phe)-Nle-HQ-Har-A-Arg($NO_2$)-(α-Me-2,6-F-Phe)-(APPA);
($AC_5C$)-V-($AC_3C$)-EIQ-(α-Me-2F-Phe)-Nle-HQ-Har-A-Arg($NO_2$)-(α-Me-2,6-F-Phe)-(APPA);

Aib-V-Aib-EIQ-(α-Me-2,6-F-Phe)-Nle-HQ-Har-A-Arg(NO₂)-(α-Me-2F-Phe)-(APPA);
(AC₃C)-V-Aib-EIQ-(α-Me-2,6-F-Phe)-Nle-HQ-Har-A-Arg(NO₂)-(α-Me-2F-Phe)-(APPA);
(AC₅C)-V-Aib-EIQ-(α-Me-2,6-F-Phe)-Nle-HQ-Har-A-Arg(NO₂)-(α-Me-2F-Phe)-(APPA);
Aib-V-(AC₃C)-EIQ-(α-Me-2,6-F-Phe)-Nle-HQ-Har-A-Arg(NO₂)-(α-Me-2F-Phe)-(APPA);
(AC₃C)-V-(AC₃C)-EIQ-(α-Me-2,6-F-Phe)-Nle-HQ-Har-A-Arg(NO₂)-(α-Me-2F-Phe)-(APPA);
(AC₅C)-V-(AC₃C)-EIQ-(α-Me-2,6-F-Phe)-Nle-HQ-Har-A-Arg(NO₂)-(α-Me-2F-Phe)-(APPA);
Aib-V-Aib-EIQ-(α-Me-2F-Phe)-Nle-HQ-Har-A-Arg(NO₂)-(α-Me-2F-Phe)-(APPA);
(AC₃C)-V-Aib-EIQ-(α-Me-2F-Phe)-Nle-HQ-Har-A-Arg(NO₂)-(α-Me-2F-Phe)-(APPA);
(AC₅C)-V-Aib-EIQ-(α-Me-2F-Phe)-Nle-HQ-Har-A-Arg(NO₂)-(α-Me-2F-Phe)-(APPA);
(AC₅C)-V-Aib-EIQ-(α-Me-2F-Phe)-Nle-HQ-Har-Aib-Arg(NO₂)-(α-Me-2F-Phe)-(APPA);
Aib-V-(AC₃C)-EIQ-(α-Me-2F-Phe)-Nle-HQ-Har-A-Arg(NO₂)-(α-Me-2F-Phe)-(APPA);
(AC₃C)-V-(AC₃C)-EIQ-(α-Me-2F-Phe)-Nle-HQ-Har-A-Arg(NO₂)-(α-Me-2F-Phe)-(APPA);
(AC₅C)-V-(AC₃C)-EIQ-(α-Me-2F-Phe)-Nle-HQ-Har-A-Arg(NO₂)-(α-Me-2F-Phe)-(APPA);
Aib-V-Aib-EIQL-Nle-HQ-Har-AR-(Bip(OMe))-(APPA);
(AC₅C)-V-Aib-EIQL-Nle-HQ-Har-AR-(Bip(OMe))-(APPA);
Aib-V-Aib-EIQL-Nle-HQ-Har-A-Cit-(Bip(OMe))-(APPA);
(AC₅C)-V-Aib-EIQL-Nle-HQ-Har-A-Cit-(Bip(OMe))-(APPA);
Aib-V-Aib-EIQL-Nle-HQ-Har-A-Aib-(Bip(OMe))-(APPA);
(AC₅C)-V-Aib-EIQL-Nle-HQ-Har-A-Aib-(Bip(OMe))-(APPA);
Aib-V-Aib-EIQL-Nle-HQ-Har-A-(α-Me-2,6-F-Phe)-(Bip(OMe))-(APPA);
(AC₅C)-V-Aib-EIQL-Nle-HQ-Har-A-(α-Me-2,6-F-Phe)-(Bip(OMe))-(APPA);
Aib-V-Aib-EIQL-Nle-HQ-Har-Aib-R-(Bip(OMe))-(APPA);
(AC₅C)-V-Aib-EIQL-Nle-HQ-Har-Aib-R-(Bip(OMe))-(APPA);
Aib-V-Aib-EIQL-Nle-HQ-Har-Aib-Cit-(Bip(OMe))-(APPA);
(AC₅C)-V-Aib-EIQL-Nle-HQ-Har-Aib-Cit-(Bip(OMe))-(APPA);
Aib-V-Aib-EIQL-Nle-HQ-Har-Aib-Aib-(Bip(OMe))-(APPA);
(AC₅C)-V-Aib-EIQL-Nle-HQ-Har-Aib-Aib-(Bip(OMe))-(APPA);
Aib-V-Aib-EIQL-Nle-HQ-Har-Aib-(α-Me-2,6-F-Phe)-(Bip(OMe))-(APPA);
(AC₅C)-V-Aib-EIQL-Nle-HQ-Har-Aib-(α-Me-2,6-F-Phe)-(Bip(OMe))-(APPA);
Aib-V-Aib-EIQL-Nle-HQ-Orn-AR-(Bip(OMe))-(APPA);
(AC₅C)-V-Aib-EIQL-Nle-HQ-Orn-AR-(Bip(OMe))-(APPA);
Aib-V-Aib-EIQL-Nle-HQ-Orn-A-Cit-(Bip(OMe))-(APPA);
(AC₅C)-V-Aib-EIQL-Nle-HQ-Orn-A-Cit-(Bip(OMe))-(APPA);
Aib-V-Aib-EIQL-Nle-HQ-Orn-A-Aib-(Bip(OMe))-(APPA);
(AC₅C)-V-Aib-EIQL-Nle-HQ-Orn-A-Aib-(Bip(OMe))-(APPA);
Aib-V-Aib-EIQL-Nle-HQ-Orn-A-(α-Me-2,6-F-Phe)-(Bip(OMe))-(APPA);
(AC₅C)-V-Aib-EIQL-Nle-HQ-Orn-A-(α-Me-2,6-F-Phe)-(Bip(OMe))-(APPA);
Aib-V-Aib-EIQL-Nle-HQ-Orn-Aib-R-(Bip(OMe))-(APPA);
(AC₅C)-V-Aib-EIQL-Nle-HQ-Orn-Aib-R-(Bip(OMe))-(APPA);
Aib-V-Aib-EIQL-Nle-HQ-Orn-Aib-Cit-(Bip(OMe))-(APPA);
(AC₅C)-V-Aib-EIQL-Nle-HQ-Orn-Aib-Cit-(Bip(OMe))-(APPA);
Aib-V-Aib-EIQL-Nle-HQ-Orn-Aib-Aib-(Bip(OMe))-(APPA);
(AC₅C)-V-Aib-EIQL-Nle-HQ-Orn-Aib-Aib-(Bip(OMe))-(APPA);
Aib-V-Aib-EIQL-Nle-HQ-Orn-Aib-(α-Me-2,6-F-Phe)-(Bip(OMe))-(APPA);
(AC₅C)-V-Aib-EIQL-Nle-HQ-Orn-Aib-(α-Me-2,6-F-Phe)-(Bip(OMe))-(APPA);
Aib-V-Aib-EIQL-Nle-HQ-Cit-AR-(Bip(OMe))-(APPA);
(AC₅C)-V-Aib-EIQL-Nle-HQ-Cit-AR-(Bip(OMe))-(APPA);
Aib-V-Aib-EIQL-Nle-HQ-Cit-A-Cit-(Bip(OMe))-(APPA);
(AC₅C)-V-Aib-EIQL-Nle-HQ-Cit-A-Cit-(Bip(OMe))-(APPA);
Aib-V-Aib-EIQL-Nle-HQ-Cit-A-Aib-(Bip(OMe))-(APPA);
(AC₅C)-V-Aib-EIQL-Nle-HQ-Cit-A-Aib-(Bip(OMe))-(APPA);
Aib-V-Aib-EIQL-Nle-HQ-Cit-A-(α-Me-2,6-F-Phe)-(Bip(OMe))-(APPA);
(AC₅C)-V-Aib-EIQL-Nle-HQ-Cit-A-(α-Me-2,6-F-Phe)-(Bip(OMe))-(APPA);
Aib-V-Aib-EIQL-Nle-HQ-Cit-Aib-R-(Bip(OMe))-(APPA);
(AC₅C)-V-Aib-EIQL-Nle-HQ-Cit-Aib-R-(Bip(OMe))-(APPA);
Aib-V-Aib-EIQL-Nle-HQ-Cit-Aib-Cit-(Bip(OMe))-(APPA);
(AC₅C)-V-Aib-EIQL-Nle-HQ-Cit-Aib-Cit-(Bip(OMe))-(APPA);
Aib-V-Aib-EIQL-Nle-HQ-Cit-Aib-Aib-(Bip(OMe))-(APPA);
(AC₅C)-V-Aib-EIQL-Nle-HQ-Cit-Aib-Aib-(Bip(OMe))-(APPA);
Aib-V-Aib-EIQL-Nle-HQ-Cit-Aib-(α-Me-2,6-F-Phe)-(Bip(OMe))-(APPA);
(AC₅C)-V-Aib-EIQL-Nle-HQ-Cit-Aib-(α-Me-2,6-F-Phe)-(Bip(OMe))-(APPA);
Aib-V-Aib-EIQL-Nle-HQ-(HoCit)-AR-(Bip(OMe))-(APPA);
(AC₅C)-V-Aib-EIQL-Nle-HQ-(HoCit)-AR-(Bip(OMe))-(APPA);
Aib-V-Aib-EIQL-Nle-HQ-(HoCit)-A-Cit-(Bip(OMe))-(APPA);
(AC₅C)-V-Aib-EIQL-Nle-HQ-(HoCit)-A-Cit-(Bip(OMe))-(APPA);
Aib-V-Aib-EIQL-Nle-HQ-(HoCit)-A-Aib-(Bip(OMe))-(APPA);
(AC₅C)-V-Aib-EIQL-Nle-HQ-(HoCit)-A-Aib-(Bip(OMe))-(APPA);
Aib-V-Aib-EIQL-Nle-HQ-(HoCit)-A-(α-Me-2,6-F-Phe)-(Bip(OMe))-(APPA);

(AC₅C)-V-Aib-EIQL-Nle-HQ-(HoCit)-A-(α-Me-2,6-F-Phe)-(Bip(OMe))-(APPA);
Aib-V-Aib-EIQL-Nle-HQ-(HoCit)-Aib-R-(Bip(OMe))-(APPA);
(AC₅C)-V-Aib-EIQL-Nle-HQ-(HoCit)-Aib-R-(Bip(OMe))-(APPA);
Aib-V-Aib-EIQL-Nle-HQ-(HoCit)-Aib-Cit-(Bip(OMe))-(APPA);
(AC₅C)-V-Aib-EIQL-Nle-HQ-(HoCit)-Aib-Cit-(Bip(OMe))-(APPA);
Aib-V-Aib-EIQL-Nle-HQ-(HoCit)-Aib-Aib-(Bip(OMe))-(APPA);
(AC₅C)-V-Aib-EIQL-Nle-HQ-(HoCit)-Aib-Aib-(Bip(OMe))-(APPA);
Aib-V-Aib-EIQL-Nle-HQ-(HoCit)-Aib-(α-Me-2,6-F-Phe)-(Bip(OMe))-(APPA);
(AC₅C)-V-Aib-EIQL-Nle-HQ-(HoCit)-Aib-(α-Me-2,6-F-Phe)-(Bip(OMe))-(APPA);
Aib-V-Aib-EIQL-Nle-HQ-(α-Me-2,6-F-Phe)-AR-(Bip(OMe))-(APPA);
(AC₅C)-V-Aib-EIQL-Nle-HQ-(α-Me-2,6-F-Phe)-AR-(Bip(OMe))-(APPA);
Aib-V-Aib-EIQL-Nle-HQ-(α-Me-2,6-F-Phe)-A-Cit-(Bip(OMe))-(APPA);
(AC₅C)-V-Aib-EIQL-Nle-HQ-(α-Me-2,6-F-Phe)-A-Cit-(Bip(OMe))-(APPA);
Aib-V-Aib-EIQL-Nle-HQ-(α-Me-2,6-F-Phe)-A-Aib-(Bip(OMe))-(APPA);
(AC₅C)-V-Aib-EIQL-Nle-HQ-(α-Me-2,6-F-Phe)-A-Aib-(Bip(OMe))-(APPA);
Aib-V-Aib-EIQL-Nle-HQ-(α-Me-2,6-F-Phe)-A-(α-Me-2,6-F-Phe)-(Bip(OMe))-(APPA);
(AC₅C)-V-Aib-EIQL-Nle-HQ-(α-Me-2,6-F-Phe)-A-(α-Me-2,6-F-Phe)-(Bip(OMe))-(APPA);
Aib-V-Aib-EIQL-Nle-HQ-(α-Me-2,6-F-Phe)-Aib-R-(Bip(OMe))-(APPA);
(AC₅C)-V-Aib-EIQL-Nle-HQ-(α-Me-2,6-F-Phe)-Aib-R-(Bip(OMe))-(APPA);
Aib-V-Aib-EIQL-Nle-HQ-(α-Me-2,6-F-Phe)-Aib-Cit-(Bip(OMe))-(APPA);
(AC₅C)-V-Aib-EIQL-Nle-HQ-(α-Me-2,6-F-Phe)-Aib-Cit-(Bip(OMe))-(APPA);
Aib-V-Aib-EIQL-Nle-HQ-(α-Me-2,6-F-Phe)-Aib-Aib-(Bip(OMe))-(APPA);
(AC₅C)-V-Aib-EIQL-Nle-HQ-(α-Me-2,6-F-Phe)-Aib-Aib-(Bip(OMe))-(APPA);
Aib-V-Aib-EIQL-Nle-HQ-(α-Me-2,6-F-Phe)-Aib-(α-Me-2,6-F-Phe)-(Bip(OMe))-(APPA);
(AC₅C)-V-Aib-EIQL-Nle-HQ-(α-Me-2,6-F-Phe)-Aib-(α-Me-2,6-F-Phe)-(Bip(OMe))-(APPA);
Aib-V-Aib-EIQ-(α-Me-2,6-F-Phe)-Nle-HQ-Har-AR-(Bip(OMe))-(APPA);
(AC₅C)-V-Aib-EIQ-(α-Me-2,6-F-Phe)-Nle-HQ-Har-AR-(Bip(OMe))-(APPA);
Aib-V-Aib-EIQ-(α-Me-2,6-F-Phe)-Nle-HQ-Har-A-Cit-(Bip(OMe))-(APPA);
(AC₅C)-V-Aib-EIQ-(α-Me-2,6-F-Phe)-Nle-HQ-Har-A-Cit-(Bip(OMe))-(APPA);
Aib-V-Aib-EIQ-(α-Me-2,6-F-Phe)-Nle-HQ-Har-A-Aib-(Bip(OMe))-(APPA);
(AC₅C)-V-Aib-EIQ-(α-Me-2,6-F-Phe)-Nle-HQ-Har-A-Aib-(Bip(OMe))-(APPA);
Aib-V-Aib-EIQ-(α-Me-2,6-F-Phe)-Nle-HQ-Har-A-(α-Me-2,6-F-Phe)-(Bip(OMe))-(APPA);
(AC₅C)-V-Aib-EIQ-(α-Me-2,6-F-Phe)-Nle-HQ-Har-A-(α-Me-2,6-F-Phe)-(Bip(OMe))-(APPA);
Aib-V-Aib-EIQ-(α-Me-2,6-F-Phe)-Nle-HQ-Har-Aib-R-(Bip(OMe))-(APPA);
(AC₅C)-V-Aib-EIQ-(α-Me-2,6-F-Phe)-Nle-HQ-Har-Aib-R-(Bip(OMe))-(APPA);
Aib-V-Aib-EIQ-(α-Me-2,6-F-Phe)-Nle-HQ-Har-Aib-Cit-(Bip(OMe))-(APPA);
(AC₅C)-V-Aib-EIQ-(α-Me-2,6-F-Phe)-Nle-HQ-Har-Aib-Cit-(Bip(OMe))-(APPA);
Aib-V-Aib-EIQ-(α-Me-2,6-F-Phe)-Nle-HQ-Har-Aib-Aib-(Bip(OMe))-(APPA);
(AC₅C)-V-Aib-EIQ-(α-Me-2,6-F-Phe)-Nle-HQ-Har-Aib-Aib-(Bip(OMe))-(APPA);
Aib-V-Aib-EIQ-(α-Me-2,6-F-Phe)-Nle-HQ-Har-Aib-(α-Me-2,6-F-Phe)-(Bip(OMe))-(APPA);
(AC₅C)-V-Aib-EIQ-(α-Me-2,6-F-Phe)-Nle-HQ-Har-Aib-(α-Me-2,6-F-Phe)-(Bip(OMe))-(APPA);
Aib-V-Aib-EIQ-(α-Me-2,6-F-Phe)-Nle-HQ-Orn-AR-(Bip(OMe))-(APPA);
(AC₅C)-V-Aib-EIQ-(α-Me-2,6-F-Phe)-Nle-HQ-Orn-AR-(Bip(OMe))-(APPA);
Aib-V-Aib-EIQ-(α-Me-2,6-F-Phe)-Nle-HQ-Orn-A-Cit-(Bip(OMe))-(APPA);
(AC₅C)-V-Aib-EIQ-(α-Me-2,6-F-Phe)-Nle-HQ-Orn-A-Cit-(Bip(OMe))-(APPA);
Aib-V-Aib-EIQ-(α-Me-2,6-F-Phe)-Nle-HQ-Orn-A-Aib-(Bip(OMe))-(APPA);
(AC₅C)-V-Aib-EIQ-(α-Me-2,6-F-Phe)-Nle-HQ-Orn-A-Aib-(Bip(OMe))-(APPA);
Aib-V-Aib-EIQ-(α-Me-2,6-F-Phe)-Nle-HQ-Orn-A-(α-Me-2,6-F-Phe)-(Bip(OMe))-(APPA);
(AC₅C)-V-Aib-EIQ-(α-Me-2,6-F-Phe)-Nle-HQ-Orn-A-(α-Me-2,6-F-Phe)-(Bip(OMe))-(APPA);
Aib-V-Aib-EIQ-(α-Me-2,6-F-Phe)-Nle-HQ-Orn-Aib-R-(Bip(OMe))-(APPA);
(AC₅C)-V-Aib-EIQ-(α-Me-2,6-F-Phe)-Nle-HQ-Orn-Aib-R-(Bip(OMe))-(APPA);
Aib-V-Aib-EIQ-(α-Me-2,6-F-Phe)-Nle-HQ-Orn-Aib-Cit-(Bip(OMe))-(APPA);
(AC₅C)-V-Aib-EIQ-(α-Me-2,6-F-Phe)-Nle-HQ-Orn-Aib-Cit-(Bip(OMe))-(APPA);
Aib-V-Aib-EIQ-(α-Me-2,6-F-Phe)-Nle-HQ-Orn-Aib-Aib-(Bip(OMe))-(APPA);
(AC₅C)-V-Aib-EIQ-(α-Me-2,6-F-Phe)-Nle-HQ-Orn-Aib-Aib-(Bip(OMe))-(APPA);
Aib-V-Aib-EIQ-(α-Me-2,6-F-Phe)-Nle-HQ-Orn-Aib-(α-Me-2,6-F-Phe)-(Bip(OMe))-(APPA);
(AC₅C)-V-Aib-EIQ-(α-Me-2,6-F-Phe)-Nle-HQ-Orn-Aib-(α-Me-2,6-F-Phe)-(Bip(OMe))-(APPA);
Aib-V-Aib-EIQ-(α-Me-2,6-F-Phe)-Nle-HQ-Cit-AR-(Bip(OMe))-(APPA);
(AC₅C)-V-Aib-EIQ-(α-Me-2,6-F-Phe)-Nle-HQ-Cit-AR-(Bip(OMe))-(APPA);
Aib-V-Aib-EIQ-(α-Me-2,6-F-Phe)-Nle-HQ-Cit-A-Cit-(Bip(OMe))-(APPA);
(AC₅C)-V-Aib-EIQ-(α-Me-2,6-F-Phe)-Nle-HQ-Cit-A-Cit-(Bip(OMe))-(APPA);
Aib-V-Aib-EIQ-(α-Me-2,6-F-Phe)-Nle-HQ-Cit-A-Aib-(Bip(OMe))-(APPA);
(AC₅C)-V-Aib-EIQ-(α-Me-2,6-F-Phe)-Nle-HQ-Cit-A-Aib-(Bip(OMe))-(APPA);
Aib-V-Aib-EIQ-(α-Me-2,6-F-Phe)-Nle-HQ-Cit-A-(α-Me-2,6-F-Phe)-(Bip(OMe))-(APPA);
(AC₅C)-V-Aib-EIQ-(α-Me-2,6-F-Phe)-Nle-HQ-Cit-A-(α-Me-2,6-F-Phe)-(Bip(OMe))-(APPA);
Aib-V-Aib-EIQ-(α-Me-2,6-F-Phe)-Nle-HQ-Cit-Aib-R-(Bip(OMe))-(APPA);

(AC₅C)-V-Aib-EIQ-(α-Me-2,6-F-Phe)-Nle-HQ-Cit-Aib-R-(Bip(OMe))-(APPA);
Aib-V-Aib-EIQ-(α-Me-2,6-F-Phe)-Nle-HQ-Cit-Aib-Cit-(Bip(OMe))-(APPA);
(AC₅C)-V-Aib-EIQ-(α-Me-2,6-F-Phe)-Nle-HQ-Cit-Aib-Cit-(Bip(OMe))-(APPA);
Aib-V-Aib-EIQ-(α-Me-2,6-F-Phe)-Nle-HQ-Cit-Aib-Aib-(Bip(OMe))-(APPA);
(AC₅C)-V-Aib-EIQ-(α-Me-2,6-F-Phe)-Nle-HQ-Cit-Aib-Aib-(Bip(OMe))-(APPA);
Aib-V-Aib-EIQ-(α-Me-2,6-F-Phe)-Nle-HQ-Cit-Aib-(α-Me-2,6-F-Phe)-(Bip(OMe))-(APPA);
(AC₅C)-V-Aib-EIQ-(α-Me-2,6-F-Phe)-Nle-HQ-Cit-Aib-(α-Me-2,6-F-Phe)-(Bip(OMe))-(APPA);
Aib-V-Aib-EIQ-(α-Me-2,6-F-Phe)-Nle-HQ-(HoCit)-AR-(Bip(OMe))-(APPA);
(AC₅C)-V-Aib-EIQ-(α-Me-2,6-F-Phe)-Nle-HQ-(HoCit)-AR-(Bip(OMe))-(APPA);
Aib-V-Aib-EIQ-(α-Me-2,6-F-Phe)-Nle-HQ-(HoCit)-A-Cit-(Bip(OMe))-(APPA);
(AC₅C)-V-Aib-EIQ-(α-Me-2,6-F-Phe)-Nle-HQ-(HoCit)-A-Cit-(Bip(OMe))-(APPA);
Aib-V-Aib-EIQ-(α-Me-2,6-F-Phe)-Nle-HQ-(HoCit)-A-Aib-(Bip(OMe))-(APPA);
(AC₅C)-V-Aib-EIQ-(α-Me-2,6-F-Phe)-Nle-HQ-(HoCit)-A-Aib-(Bip(OMe))-(APPA);
Aib-V-Aib-EIQ-(α-Me-2,6-F-Phe)-Nle-HQ-(HoCit)-A-(α-Me-2,6-F-Phe)-(Bip(OMe))-(APPA);
(AC₅C)-V-Aib-EIQ-(α-Me-2,6-F-Phe)-Nle-HQ-(HoCit)-A-(α-Me-2,6-F-Phe)-(Bip(OMe))-(APPA);
Aib-V-Aib-EIQ-(α-Me-2,6-F-Phe)-Nle-HQ-(HoCit)-Aib-R-(Bip(OMe))-(APPA);
(AC₅C)-V-Aib-EIQ-(α-Me-2,6-F-Phe)-Nle-HQ-(HoCit)-Aib-R-(Bip(OMe))-(APPA);
Aib-V-Aib-EIQ-(α-Me-2,6-F-Phe)-Nle-HQ-(HoCit)-Aib-Cit-(Bip(OMe))-(APPA);
(AC₅C)-V-Aib-EIQ-(α-Me-2,6-F-Phe)-Nle-HQ-(HoCit)-Aib-Cit-(Bip(OMe))-(APPA);
Aib-V-Aib-EIQ-(α-Me-2,6-F-Phe)-Nle-HQ-(HoCit)-Aib-Aib-(Bip(OMe))-(APPA);
(AC₅C)-V-Aib-EIQ-(α-Me-2,6-F-Phe)-Nle-HQ-(HoCit)-Aib-Aib-(Bip(OMe))-(APPA);
Aib-V-Aib-EIQ-(α-Me-2,6-F-Phe)-Nle-HQ-(HoCit)-Aib-(α-Me-2,6-F-Phe)-(Bip(OMe))-(APPA);
(AC₅C)-V-Aib-EIQ-(α-Me-2,6-F-Phe)-Nle-HQ-(HoCit)-Aib-(α-Me-2,6-F-Phe)-(Bip(OMe))-(APPA);
Aib-V-Aib-EIQ-(α-Me-2,6-F-Phe)-Nle-HQ-(α-Me-2,6-F-Phe)-AR-(Bip(OMe))-(APPA);
(AC₅C)-V-Aib-EIQ-(α-Me-2,6-F-Phe)-Nle-HQ-(α-Me-2,6-F-Phe)-AR-(Bip(OMe))-(APPA);
Aib-V-Aib-EIQ-(α-Me-2,6-F-Phe)-Nle-HQ-(α-Me-2,6-F-Phe)-A-Cit-(Bip(OMe))-(APPA);
(AC₅C)-V-Aib-EIQ-(α-Me-2,6-F-Phe)-Nle-HQ-(α-Me-2,6-F-Phe)-A-Cit-(Bip(OMe))-(APPA);
Aib-V-Aib-EIQ-(α-Me-2,6-F-Phe)-Nle-HQ-(α-Me-2,6-F-Phe)-A-Aib-(Bip(OMe))-(APPA);
(AC₅C)-V-Aib-EIQ-(α-Me-2,6-F-Phe)-Nle-HQ-(α-Me-2,6-F-Phe)-A-Aib-(Bip(OMe))-(APPA);
Aib-V-Aib-EIQ-(α-Me-2,6-F-Phe)-Nle-HQ-(α-Me-2,6-F-Phe)-A-(α-Me-2,6-F-Phe)-(Bip(OMe))-(APPA);
(AC₅C)-V-Aib-EIQ-(α-Me-2,6-F-Phe)-Nle-HQ-(α-Me-2,6-F-Phe)-A-(α-Me-2,6-F-Phe)-(Bip(OMe))-(APPA);
Aib-V-Aib-EIQ-(α-Me-2,6-F-Phe)-Nle-HQ-(α-Me-2,6-F-Phe)-Aib-R-(Bip(OMe))-(APPA);
(AC₅C)-V-Aib-EIQ-(α-Me-2,6-F-Phe)-Nle-HQ-(α-Me-2,6-F-Phe)-Aib-R-(Bip(OMe))-(APPA);
Aib-V-Aib-EIQ-(α-Me-2,6-F-Phe)-Nle-HQ-(α-Me-2,6-F-Phe)-Aib-Cit-(Bip(OMe))-(APPA);
(AC₅C)-V-Aib-EIQ-(α-Me-2,6-F-Phe)-Nle-HQ-(α-Me-2,6-F-Phe)-Aib-Cit-(Bip(OMe))-(APPA);
Aib-V-Aib-EIQ-(α-Me-2,6-F-Phe)-Nle-HQ-(α-Me-2,6-F-Phe)-Aib-Aib-(Bip(OMe))-(APPA);
(AC₅C)-V-Aib-EIQ-(α-Me-2,6-F-Phe)-Nle-HQ-(α-Me-2,6-F-Phe)-Aib-Aib-(Bip(OMe))-(APPA);
Aib-V-Aib-EIQ-(α-Me-2,6-F-Phe)-Nle-HQ-(α-Me-2,6-F-Phe)-Aib-(α-Me-2,6-F-Phe)-(Bip(OMe))-(APPA);
(AC₅C)-V-Aib-EIQ-(α-Me-2,6-F-Phe)-Nle-HQ-(α-Me-2,6-F-Phe)-Aib-(α-Me-2,6-F-Phe)-(Bip(OMe))-(APPA);
Aib-V-Aib-EIQLMHQ-Har-AK-(αMe-Bip(OMe))-(APPA);
Aib-V-Aib-EIQL-Nle-HQ-Har-AK-(αMe-Bip(OMe))-(APPA);
V-Aib-V-Aib-EIQLMHQ-Har-AK-(Bip(OMe))-(αMe-APPA);
V-Aib-V-Aib-EIQL-Nle-HQ-Har-AK-(Bip(OMe))-(αMe-APPA);
(αMe-V)-(AC₅C)-V-Aib-EIQLMHQ-Har-AK-(Bip(OMe))-(αMe-APPA);
(αMe-V)-(AC₅C)-V-Aib-EIQL-Nle-HQ-Har-AK-(Bip(OMe))-(αMe-APPA);
(NMe-V)-(AC₅C)-V-Aib-EIQLMHQ-Har-AK-(Bip(OMe))-(αMe-APPA);
(NMe-V)-(AC₅C)-V-Aib-EIQL-Nle-HQ-Har-AK-(Bip(OMe))-(αMe-APPA);
Aib-V-Aib-EIQLMHQ-Har-A-Har-(αMe-Bip(OMe))-(APPA);
Aib-V-Aib-EIQL-Nle-HQ-Har-A-Har-(αMe-Bip(OMe))-(APPA);
Aib-V-Aib-EIQLMHQ-Har-A-Har-(Bip(OMe))-(αMe-APPA);
Aib-V-Aib-EIQL-Nle-HQ-Har-A-Har-(Bip(OMe))-(αMe-APPA);
V-Aib-V-Aib-EIQLMHQ-Har-A-Har-(αMe-Bip(OMe))-(APPA);
V-Aib-V-Aib-EIQL-Nle-HQ-Har-A-Har-(αMe-Bip(OMe))-(APPA);
V-Aib-V-Aib-EIQLMHQ-Har-A-Har-(Bip(OMe))-(αMe-APPA);
V-Aib-V-Aib-EIQL-Nle-HQ-Har-A-Har-(Bip(OMe))-(αMe-APPA);
(αMe-V)-(AC₅C)-V-Aib-EIQLMHQ-Har-A-Har-(Bip(OMe))-(αMe-APPA);
(αMe-V)-(AC₅C)-V-Aib-EIQL-Nle-HQ-Har-A-Har-(Bip(OMe))-(αMe-APPA);
(NMe-V)-(AC₅C)-V-Aib-EIQLMHQ-Har-A-Har-(Bip(OMe))-(αMe-APPA);
(NMe-V)-(AC₅C)-V-Aib-EIQL-Nle-HQ-Har-A-Har-(Bip(OMe))-(αMe-APPA);
Aib-V-Aib-EIQL-(αMe-M)-HQ-Har-A-Har-(αMe-Bip(OMe))-(APPA);
Aib-V-Aib-EIQL-(αMe-Nle)-HQ-Har-A-Har-(αMe-Bip(OMe))-(APPA);
Aib-V-Aib-EIQL-(αMe-M)-HQ-Har-A-Har-(Bip(OMe))-(αMe-APPA);
Aib-V-Aib-EIQL-(αMe-Nle)-HQ-Har-A-Har-(Bip(OMe))-(αMe-APPA);
V-Aib-V-Aib-EIQL-(αMe-M)-HQ-Har-A-Har-(αMe-Bip(OMe))-(APPA);
V-Aib-V-Aib-EIQL-(αMe-Nle)-HQ-Har-A-Har-(αMe-Bip(OMe))-(APPA);
V-(AC₃C)-V-Aib-EIQL-(αMe-M)-HQ-Har-A-Har-(αMe-Bip(OMe))-(APPA);

V-(AC₃C)-V-Aib-EIQL-(αMe-Nle)-HQ-Har-A-Har-(αMe-Bip(OMe))-(APPA);
V-(AC₅C)-V-Aib-EIQL-(αMe-M)-HQ-Har-A-Har-(αMe-Bip(OMe))-(APPA);
V-(AC₅C)-V-Aib-EIQL-(αMe-Nle)-HQ-Har-A-Har-(αMe-Bip(OMe))-(APPA);
V-Aib-V-Aib-EIQL-(αMe-M)-HQ-Har-A-Har-(Bip(OMe))-(αMe-APPA);
V-Aib-V-Aib-EIQL-(αMe-Nle)-HQ-Har-A-Har-(Bip(OMe))-(αMe-APPA);
V-(AC₃C)-V-Aib-EIQL-(αMe-M)-HQ-Har-A-Har-(Bip(OMe))-(αMe-APPA);
V-(AC₃C)-V-Aib-EIQL-(αMe-Nle)-HQ-Har-A-Har-(Bip(OMe))-(αMe-APPA);
V-(AC₅C)-V-Aib-EIQL-(αMe-M)-HQ-Har-A-Har-(Bip(OMe))-(αMe-APPA);
V-(AC₅C)-V-Aib-EIQL-(αMe-Nle)-HQ-Har-A-Har-(Bip(OMe))-(αMe-APPA);
(αMe-V)-(AC₅C)-V-Aib-EIQL-(αMe-M)-HQ-Har-A-Har-(Bip(OMe))-(αMe-APPA);
(αMe-V)-(AC₅C)-V-Aib-EIQL-(αMe-Nle)-HQ-Har-A-Har-(Bip(OMe))-(αMe-APPA);
(NMe-V)-(AC₅C)-V-Aib-EIQL-(αMe-M)-HQ-Har-A-Har-(Bip(OMe))-(αMe-APPA);
(NMe-V)-(AC₅C)-V-Aib-EIQL-(αMe-Nle)-HQ-Har-A-Har-(Bip(OMe))-(αMe-APPA);
Aib-V-Aib-EIQL-(αMe-M)-HQ-Har-A-Har-(αMe-2FPhe)-(APPA);
Aib-V-Aib-EIQL-(αMe-Nle)-HQ-Har-A-Har-(αMe-2FPhe)-(APPA);
V-Aib-V-Aib-EIQL-(αMe-M)-HQ-Har-A-Har-(αMe-2FPhe)-(ocMe-APPA);
V-Aib-V-Aib-EIQL-(αMe-Nle)-HQ-Har-A-Har-(αMe-2FPhe)-(αMe-APPA);
V-(AC₃C)-V-Aib-EIQL-(αMe-M)-HQ-Har-A-Har-(αMe-2FPhe)-(αMe-APPA);
V-(AC₃C)-V-Aib-EIQL-(αMe-Nle)-HQ-Har-A-Har-(αMe-2FPhe)-(αMe-APPA);
V-(AC₅C)-V-Aib-EIQL-(αMe-M)-HQ-Har-A-Har-(αMe-2FPhe)-(αMe-APPA);
V-(AC₅C)-V-Aib-EIQL-(αMe-Nle)-HQ-Har-A-Har-(αMe-2FPhe)-(αMe-APPA);
(αMe-V)-(AC₅C)-V-Aib-EIQL-(αMe-M)-HQ-Har-A-Har-(αMe-2FPhe)-(αMe-APPA);
(αMe-V)-(AC₅C)-V-Aib-EIQL-(αMe-Nle)-HQ-Har-A-Har-(αMe-2FPhe)-(αMe-APPA);
(NMe-V)-(AC₅C)-V-Aib-EIQL-(αMe-M)-HQ-Har-A-Har-(αMe-2FPhe)-(αMe-APPA);
(NMe-V)-(AC₅C)-V-Aib-EIQL-(αMe-Nle)-HQ-Har-A-Har-(αMe-2FPhe)-(αMe-APPA);
Aib-V-Aib-EIQL-(αMe-M)-HQ-Har-A-Har-(αMe-Trp)-(APPA);
Aib-V-Aib-EIQL-(αMe-Nle)-HQ-Har-A-Har-(αMe-Trp)-(APPA);
(AC₃C)-V-Aib-EIQL-(αMe-M)-HQ-Har-A-Har-(αMe-Trp)-(APPA);
(AC₃C)-V-Aib-EIQL-(αMe-Nle)-HQ-Har-A-Har-(αMe-Trp)-(APPA);
(AC₅C)-V-Aib-EIQL-(αMe-M)-HQ-Har-A-Har-(αMe-Trp)-(APPA);
(AC₅C)-V-Aib-EIQL-(αMe-Nle)-HQ-Har-A-Har-(αMe-Trp)-(APPA);
Aib-V-Aib-EIQL-(αMe-M)-HQ-Har-A-Har-(αMe-Trp)-(αMe-APPA);
Aib-V-Aib-EIQL-(αMe-Nle)-HQ-Har-A-Har-(αMe-Trp)-(ocMe-APPA);
V-(AC₃C)-V-Aib-EIQL-(αMe-M)-HQ-Har-A-Har-(αMe-Trp)-(αMe-APPA);
V-(AC₃C)-V-Aib-EIQL-(αMe-Nle)-HQ-Har-A-Har-(αMe-Trp)-(αMe-APPA);
V-(AC₅C)-V-Aib-EIQL-(αMe-M)-HQ-Har-A-Har-(αMe-Trp)-(αMe-APPA);
V-(AC₅C)-V-Aib-EIQL-(αMe-Nle)-HQ-Har-A-Har-(αMe-Trp)-(αMe-APPA);
(αMe-V)-(AC₅C)-V-Aib-EIQL-(αMe-M)-HQ-Har-A-Har-(αMe-Trp)-(αMe-APPA); and
(αMe-V)-(AC₅C)-V-Aib-EIQL-(αMe-Nle)-HQ-Har-A-Har-(αMe-Trp)-(αMe-APPA).

18. A pharmaceutical composition comprising one or more compounds of formula (I) as claimed in claim 1, and one or more pharmaceutically acceptable excipient(s).

19. A method of treating diseases caused by primary osteoporosis, endocrine osteoporosis, hereditary and congenital forms of osteoporosis, osteoporosis due to immobilization, chronic obstructive pulmonary disease or rheumatologic disorders (rheumatoid arthritis, spondylitis), osteomyelitis or an infectious lesion in bone, comprising administering an effective, non-toxic amount of compound of formula (I) as defined in claim 1 to a patient in need thereof.

20. A pharmaceutical composition comprising one or more compounds of formula (I) as claimed in claim 17, and one or more pharmaceutically acceptable excipient(s).

* * * * *